US008299041B2

(12) United States Patent
Bhanot et al.

(10) Patent No.: US 8,299,041 B2
(45) Date of Patent: Oct. 30, 2012

(54) COMPOSITIONS AND THEIR USES DIRECTED TO ACETYL-COA CARBOXYLASES

(75) Inventors: Sanjay Bhanot, Carlsbad, CA (US); Brett P. Monia, Encinitas, CA (US); John G. Geisler, Vista, CA (US); Robert McKay, San Diego, CA (US); Kenneth W. Dobie, San Diego, CA (US)

(73) Assignee: Isis Pharmaceuticals, Inc., Carlsbad, CA (US)

( * ) Notice: Subject to any disclaimer, the term of this patent is extended or adjusted under 35 U.S.C. 154(b) by 651 days.

(21) Appl. No.: 11/910,606

(22) PCT Filed: Apr. 10, 2006

(86) PCT No.: PCT/US2006/013536
§ 371 (c)(1),
(2), (4) Date: Aug. 18, 2009

(87) PCT Pub. No.: WO2006/110775
PCT Pub. Date: Oct. 19, 2006

(65) Prior Publication Data
US 2011/0136889 A1    Jun. 9, 2011

Related U.S. Application Data

(60) Provisional application No. 60/669,530, filed on Apr. 8, 2005.

(30) Foreign Application Priority Data

Mar. 17, 2006    (WO) ................ PCT/US2006/009695

(51) Int. Cl.
*A61K 48/00*    (2006.01)

(52) U.S. Cl. ...... 514/44; 536/24.5; 536/24.31; 536/24.1
(58) Field of Classification Search .................... None
See application file for complete search history.

(56) References Cited

U.S. PATENT DOCUMENTS

| | | | |
|---|---|---|---|
| 5,801,154 | A | 9/1998 | Baracchini et al. |
| 5,998,148 | A | 12/1999 | Bennett et al. |
| 6,582,908 | B2 | 6/2003 | Fodor et al. |
| 2001/0053519 | A1 | 12/2001 | Fodor et al. |
| 2003/0228597 | A1 | 12/2003 | Cowsert et al. |
| 2005/0009163 | A1 | 1/2005 | Tong et al. |
| 2005/0020527 | A1 | 1/2005 | Peters et al. |
| 2005/0026160 | A1 | 2/2005 | Allerson et al. |
| 2005/0124568 | A1 | 6/2005 | Usman et al. |
| 2007/0031844 | A1 | 2/2007 | Khvorova et al. |

FOREIGN PATENT DOCUMENTS

| | | |
|---|---|---|
| WO | WO 93/24510 | 12/1993 |
| WO | WO 94/26764 | 11/1994 |
| WO | WO 02/40637 | 5/2002 |
| WO | WO 2005/007859 | 1/2005 |

OTHER PUBLICATIONS

Jiang et al. (J Clinical Investigation Apr. 2005, published online Mar. 10, 2005).*
Savage et al. J. Clinical Investigation 2006, Mar. 116(3): 817-824.*
Barbaro et al. (The Lancet 2001: 115-1240).*
Sanghvi et al., "Heterocyclic Base Modifications in Nucleic Acids and Their Applications in Antisense Oligonucleotides" Antisense Research and Applications (1993) pp. 273-288.
International Search Report for application PCT/US2006/013536 dated May 7, 2010.
Agrawal, S. et al., "Antisense therapeutics: is it as simple as complementary base recognition" Molecular Med. Today (2000) 6:72-81.
Agrawal et al., "Antisense oligonucleotides: towards clinical trials" TIBTECH (1996) 14:376-387.
Agrawal, Protocols for Oligonucleotides and Analogs (1993) Humana Press.
Altschul et al., "Basic Local Alignment Search Tool" J. Mol. Biol. (1990) 215:403-410.
Ausubel et al., Current Protocols in Molecular Biology, vol. 1, pp. 4.1.1-4.2.9, 4.5.1-4.5.3 (1993) John Wiley & Sons, Inc.
Ausubel et al., Current Protocols in Molecular Biology, vol. 2, pp. 11.12.1-11.12.9 (1997) John Wiley & Sons, Inc.
Bennett et al., "Antisense oligonucleotides as a tool for gene functionalization and target validation". Biochem. Biophys. Acta (1999) 1489(1):19-30.
Berger et al., "Universal bases for hybridization, replication and chain termination" Nuc. Acid. Res. (2000) 28:2911-2914.
Braasch et al., "Novel Antisense and Peptide Nucleic Acid Strategies for Controlling Gene Expression" Biochemistry (2002) 41:4503-4510.
Branch et al., "A good antisense molecule is hard to find" TIBS (1998) 23:45-50.
Browning et al., "Molecular mediators of hepatic steatosis and liver injury" J. Clin. Invest. (2004) 114:147-152.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.
Crystal et al., "Transfer of genes to humans: early lessons and obstacles to success" Science (1995) 270:404-410.
Deverre et al., "A competitive enzyme hybridization assay for plasma determination of phosphodiester and phosphorothioate antisense oligonucleotides" Nucleic Acids Res. (1997) 25:3584-3589.
Executive Summary of the Third Report of the National Cholesterol Education Program (NCEP) Expert Panel on Detection, Evaluation, and Treatment of High Blood Cholesterol in Adults (Adul Treatment Panel III), JAMA (2001) 285:2486-2497.

(Continued)

*Primary Examiner* — Kimberly Chong
(74) *Attorney, Agent, or Firm* — Isis Pharmaceuticals, Inc. Patent Dept.

(57) ABSTRACT

Disclosed herein are compounds, compositions and methods for modulating the expression of ACC1 or ACC2 or both in a cell, tissue or animal. Also provided are uses of disclosed compounds and compositions in the manufacture of a medicament for treatment of diseases and disorders.

41 Claims, No Drawings

OTHER PUBLICATIONS

Friedmann et al., "Overcoming the Obstacles to gene therapy" Scientific American (1997) 276:96-101.
Gait et al., Applications of Chemically Synthesized RNA In RNA: Protein Interactions, Ed. Smith (1998) 1-36.
Gallo et al., "2'-C-Methyluridine phosphoramidite: a new building block for the preparation of RNA analogues carrying the 2'-hydroxyl group" Tetrahedron (2001) 57:5707-5713.
Gewirtz et al., "Facilitating oligonucleotide delivery: Helping antisense deliver on its promise" PNAS (1996) 93:3161-3163.
Harwood, Acetyl-CoA carboxylase inhibition for the treatment of metabolic syndrome' Curr. Opin. Investig. Drugs (2004) 5:283-289.
Jen, "Suppression of Gene Expression by Targeted Disruption of Messenger RNA: Available Options and Current Strategies" Stem Cells (2000) 18:307-319.
Ma et al., "Synthetic oligonucleotides as therapeutics: the coming age," Biotechnology Annual Review (2000) 5:155-196.
Maher et al., "Comparative hybrid arrest by tandem antisense oligodeoxyribonucleotides or oligodeoxyribonucleoside methylphosphonates in a cell-free system" Nuc. Acid. Res. (1988) 16:3341-3358.
McGarry et al., "The Role of Malonyl-CoA in the Coordination of Fatty Acid Synthesis and Oxidation in Isolated Rat Hepatocytes" J. Biol. Chem. (1978) 253:8294-8300.
Milligan et al., "Current Concepts in Antisense Drug Design" J. Medicinal Chemistry (1993) 36: 1923-1927.
New England Biolabs, 1998/1999 Catalog, pp. 121 and 284.
Ohmichi et al., "The virtues of self-binding: high sequence specificity for RNA cleavage by self-processed hammerhead ribozymes" Nucleic Acids Res. (2000) 28:776-783.
Opalinski et al., "Nucleic-Acid Therapeutics: Basic Principles and Recent Applications" Nature Reviews (2002) 1:503-514.
Palu et al., "In Pursuit of new developments for gene therapy of human disease" J. Biotech. (1999) 68:1-13.
Peracchi et al., "Prospects for antiviral ribozymes and deoxyribozymes" Rev. in Med. (2004) 14:47-64.
Reynolds et al., "Rational siRNA design for RNA interference" Nature Biotechnology (2004) 22(3):326-330.
Scaringe, "RNA Oligonucleotide Synthesis via 5'-Silyl-2'-Orthoester Chemistry" Methods (2001) 23:206-217.
Schofield et al., "Non-viral approaches to gene therapy" Brit. Med. Bull. (1995) 51:56-71.
Shimamura et al., "Leptin and insulin down-regulate angiopoietin-like protein 3, a plasma triglyceride-increasing factor" Biochem. Biophys. Res. Commun. (2004) 322:1080-1085.
Smith et al., "Comparison of Biosequences" Adv. Appl. Math (1981) 2:482-489.
Stein et al., "Antisense oligonucleotides as therapeutic agents—is the bullet really magical?" Science (1993) 261:1004-1012.
Verma et al., "Gene Therapy: promises, problems and prospects" Nature (1997) 389:239-242.
Vickers et al., "Efficient reduction of target RNAs by small interfering RNA and Rnase H-dependent antisense agents" The Journal of Biological Chemistry (2003) 278:7108-7118.
Weintraub et al., "Antisense RNA and DNA" Scientific American (1990) 40-46.
Woolf et al., "Specificity of antisense oligonucleotides in vivo" PNAS (1992) 89:7305-7309.
Zhang et al., "PowerBLAST: A New Network BLAST Application for Interactive or Automated Sequence Analysis and Annotation" Genome Res. (1997) 7:649-656.
Jiang et al., "Prevention of obesity in mice by antisense oligonucleotide inhibitors of stearoyl-CoA desaturase-1," J. Clin. Invest. 115(4):1030-1038 (2005).
International Search Report of PCT/US2006/013536, dated May 7, 2010.
Altmann et al., "Novel Chemistry" Applied Antisense Oligonucloeitde Technology (1998) 73-107.
Zhang et al., "Acetyl-CoA carboxylase is essential for nutrient-induced insulin secretion" Biochemical and Biophysical Research Communications (1996) 229(3):701-705.
Zhang et al., "Essential role of acetyl-CoA carboxylase in the glucose-induced insulin secretion in a pancreatic beta-cell line" Cellular Signaling (1998) 10(1):35-42.
European Search Report for application EP 06749800 dated Jun. 7, 2011.

* cited by examiner

COMPOSITIONS AND THEIR USES DIRECTED TO ACETYL-COA CARBOXYLASES

CROSS-REFERENCE TO RELATED APPLICATIONS

This application claims priority to U.S. Provisional Patent Application Ser. No. 60/669,530, filed Apr. 8, 2005, the entirety of which is herein incorporated by reference.

SEQUENCE LISTING

A paper copy of the sequence listing and a computer-readable form of the sequence listing, on diskette, containing the file named BIOL0058WOSEQ, which was created on Apr. 10, 2006, are herein incorporated by reference

FIELD OF THE INVENTION

Disclosed herein are compounds, compositions and methods useful for modulating the expression of ACC1 or ACC2 in a cell, tissue or animal.

BACKGROUND OF THE INVENTION

Acetyl-CoA carboxylase (ACC) activity is responsible for the ATP-dependent carboxylation of acetyl-CoA to malonyl-CoA, the rate-limiting step in fatty acid synthesis. This reaction proceeds in two half-reactions: a biotin carboxylase reaction and a carboxyltransferase reaction. Malonyl-CoA is the carbon donor in the synthesis of long chain fatty acids and in their elongation into very long chain fatty acids, and is also a regulator of the palmitoyl-CoA-carnitine shuttle system that is involved in the mitochondrial oxidation of long chain fatty acids (Harwood, *Curr. Opin. Investig. Drugs,* 2004, 5, 283-289; McGarry et al., *J. Biol. Chem.,* 1978, 253, 8294-8300).

Malonyl-CoA, the product of ACC activity, is the key metabolic signal for the control of fatty acid oxidation and synthesis in response to dietary changes. The carboxylases are highly regulated by diet, hormones, and other physiological factors. Food intake induces the synthesis of ACC and increases ACC activity. Starvation or diabetes mellitus represses the expression of the genes and decreases the activities of the enzymes. Treating diabetic animals with insulin increases the activity of the enzyme, and prolonged insulin treatment stimulates the synthesis of ACC protein.

ACC exists as two tissue-specific isozymes: ACC1 (also known as acetyl-CoA carboxylase alpha; ACAC; ACACA; and tgf) which is present in lipogenic tissues such as liver and adipose and ACC2 (also known as acetyl-Coenzyme A carboxylase beta, ACACB, ACCB, HACC275, and acetyl-CoA carboxylase 2) which is present in oxidative tissues such as liver, heart and skeletal muscle. ACC1 and ACC2 are encoded by separate genes (Harwood, *Curr. Opin. Investig. Drugs,* 2004, 5, 283-289).

Use of antisense oligonucleotides to decrease ACC1 and ACC2 for therapeutics is advantageous over small molecules in that antisense oligonucleotides will not decrease ACC levels in the central nervous system or pancreas, thus preventing side effects observed with small molecule inhibition of ACC1 and ACC2.

SUMMARY OF THE INVENTION

The present invention is directed to methods of using compounds, particularly antisense compounds, targeted to a nucleic acid molecule encoding ACC1 or ACC2 and which modulate the expression of ACC1, ACC2, or both ACC1 and ACC2 to achieve particular phenotypic endpoints. Further provided are methods of reducing ACC1 or ACC2 or both ACC1 and ACC2 concurrently in cells, tissues or animals comprising contacting said cells, tissues or animals with one or more of the compounds or compositions of the present invention.

The present invention provides methods of lowering blood glucose, triglycerides, or cholesterol, in a subject in need of such treatment, by administering to said subject an antisense compound which reduces ACC1 or ACC2. In a preferred embodiment, the antisense compound reduces both ACC1 and ACC2. In another embodiment, the present invention provides methods of lowering adiposity. In another embodiment, the present invention provides methods of lowering liver triglyceride levels. Another embodiment of the present invention is a method of inhibiting fatty acid synthesis. Other embodiments include methods of stimulating fatty acid oxidation, improving insulin sensitivity, and inhibiting hepatic glucose output in a subject in need of such treatment, by administering to said subject an antisense compound which reduces ACC1 or ACC2 or both ACC1 and ACC2.

In other embodiments, the present invention provides methods of ameliorating or lessening the severity of a condition in an animal comprising contacting said animal with an effective amount of an antisense compound which reduces ACC1, ACC2, or both ACC1 and ACC2 so that measurement of one or more physical indices of said condition indicates a lessening of the severity of said condition. In one embodiment, the condition is obesity. In another embodiment, the obesity is diet-induced. In other embodiments, conditions include, but are not limited to, diabetes, insulin resistance, insulin deficiency, hypercholesterolemia, hyperglycemia, hypertriglyceridemia, hyperfattyacidemia, metabolic syndrome, and cardiovascular disease. In another embodiment, the condition is liver steatosis. In another embodiment, the liver steatosis is steatohepatitis, non-alcoholic fatty liver disease (NAFLD) or non-alcoholic steatohepatitis (NASH). Also contemplated herein is the use of a compound of the invention in the preparation of a medicament for amelioration or treatment of a condition associated with ACC1 or ACC2 or both.

In some embodiments, antisense compounds modulate ACC1, ACC2, or both ACC1 and ACC2. Contemplated and provided herein are antisense compounds comprising sequences of 13 to 30 nucleotides in length. Also provided herein are antisense compounds with at least two modifications selected from a modified internucleoside linkage, a modified nucleobase, or a modified sugar. Provided herein are chimeric oligonucleotides comprising a deoxy nucleotide region flanked on each of the 5' and 3' ends with at least one 2'-O-methoxylethyl nucleotide. Further provided are chimeric oligonucleotides comprising ten deoxynucleotides and flanked on both the 5' and 3' ends with five 2'-O-methoxyethyl nucleotides wherein each internucleoside linkage is a phosphorothioate. In a further embodiment, the antisense compounds of the present invention may have at least one 5-methylcytosine.

DETAILED DESCRIPTION OF THE INVENTION

Overview

Disclosed herein are antisense compounds and methods of using said antisense compounds, including antisense oligonucleotides which reduce ACC1 or ACC2 or both ACC1 and ACC2. Such methods are accomplished by providing antisense compounds which are complementary to one or more target nucleic acid molecules encoding ACC1 or ACC2.

In accordance with the present invention are compositions and methods for modulating the expression of ACC1 (also known as acetyl-CoA carboxylase alpha, ACAC, ACACA, and tgf) or ACC2 (also known as acetyl-Coenzyme A carboxylase beta, ACACB, ACCB, HACC275, and acetyl-CoA carboxylase 2). Listed in Table 1 are GENBANK® accession numbers of sequences useful for design of antisense compounds targeted to ACC1 or ACC2 or both ACC1 and ACC2. Each GENBANK® sequence is herein incorporated by reference. Shown in Table 1 is the SEQ ID NO of such sequences if assigned. Antisense compounds of the invention include those which reduce one or more target nucleic acid molecules shown in Table 1, as well as antisense compounds which reduce other nucleic acid molecules encoding ACC1 or ACC2. The antisense compounds may target any region, segment, or site of nucleic acid molecules which encode ACC1 or ACC2. Suitable target regions are described herein.

TABLE 1

Gene Target Names and Sequences

| Target | Species | GENBANK ® # | Date of deposit in GENBANK ® | SEQ ID NO |
|---|---|---|---|---|
| ACC1 | Human | NM_000664.3 | | 1 |
| ACC1 | Human | NM_198834.1 | | 2 |
| ACC1 | Human | NM_198835.1 | Dec. 04, 2003 | n/a |
| ACC1 | Human | NM_198836.1 | | 4 |
| ACC1 | Human | NM_198837.1 | | 5 |
| ACC1 | Human | NM_198838.1 | | 6 |
| ACC1 | Human | the complement of nucleotides 715679 to 1041454 of NT_078100.1 | | 7 |
| ACC1 | Mouse | XM_109883.5 | | 8 |
| ACC2 | Human | AJ575592.3 | | 9 |
| ACC2 | Human | BC028417.1 | | 10 |
| ACC2 | Human | N88277.1 | Apr. 02, 1996 | n/a |
| ACC2 | Human | NM_001093.1 | | 12 |
| ACC2 | Human | nucleotides 146320 to 274076 of NT_009775.14 | | 13 |
| ACC2 | Human | R99037.1 | Sep. 15, 2005 | n/a |
| ACC2 | Human | the complement of T27637.1 | Jan. 04, 1995 | n/a |
| ACC2 | Mouse | BC022940.1 | Feb. 07, 2002 | n/a |
| ACC2 | Mouse | NM_133904.1 | | 17 |
| ACC2 | Mouse | nucleotides 628385 to 716000 of NT_078458.2 | | 18 |
| ACC2 | Mouse | Assembled from BF783883 | Jan. 05, 2001 | n/a |
| ACC2 | Mouse | AF290179 | Dec. 11, 2001 | n/a |
| ACC2 | Rat | AB004329.1 | Apr. 24, 1998 | n/a |
| ACC2 | Rat | CB699897.1 | Apr. 10, 2003 | n/a |
| ACC2 | Rat | the complement of nucleotides 22000 to 127000 of NW_047377.1 | Sep. 22, 2003 | n/a |
| ACC2 | Rat | XM_346441.1 | Sep. 22, 2003 | n/a |

Embodiments of the present invention include antisense compounds comprising sequences of 12 to 50 nucleotides in length. It is understood that sequences of 12 to 50 nucleotides in length encompass sequences of 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50 nucleotides in length. Preferred are antisense oligonucleotides 13 to 30 nucleotides in length. Also preferred are antisense oligonucleotides 12 to 30 nucleotides in length. One of ordinary skill will readily appreciate that the nucleotide length range 12 to 50 includes all nucleotide lengths within that range as well any range falling within the bounds of 12 to 50 nucleotides.

It is well known by those skilled in the art that it is possible to increase or decrease the length of an antisense compound and/or introduce mismatch bases without eliminating activity. For example, in Woolf et al. (Proc. Natl. Acad. Sci. USA 89:7305-7309, 1992, incorporated herein by reference), a series of ASOs 13-25 nucleobases in length were tested for their ability to induce cleavage of a target RNA in an oocyte injection model. ASOs 25 nucleobases in length with 8 or 11 mismatch bases near the ends of the ASOs were able to direct specific cleavage of the target mRNA, albeit to a lesser extent than the ASOs that contained no mismatches. Similarly, target specific cleavage was achieved using a 13 nucleobase ASOs, including those with 1 or 3 mismatches. Maher and Dolnick (Nuc. Acid. Res. 16:3341-3358, 1988, incorporated herein by reference) tested a series of tandem 14 nucleobase ASOs, and a 28 and 42 nucleobase ASOs comprised of the sequence of two or three of the tandem ASOs, respectively, for their ability to arrest translation of human DHFR in a rabbit reticulocyte assay. Each of the three 14 nucleobase ASOs alone were able to inhibit translation, albeit at a more modest level than the 28 or 42 nucleobase ASOs.

Therapeutics

Compounds of the invention can be used to modulate ACC1 or ACC2 in an animal, such as a human. In one non-limiting embodiment, the methods comprise the step of administering to said animal an effective amount of an antisense compound that decreases expression of ACC1 or ACC2 or, preferably, both. In one embodiment, the antisense compounds of the present invention effectively decrease the levels or function of ACC1 or ACC2 RNA. Because reduction in ACC1 or ACC2 mRNA levels can lead to reduction in ACC1 or ACC2 protein products of expression as well, such resultant alterations can also be measured. Antisense compounds of the present invention that effectively decrease levels or function of an ACC1 or ACC2 RNA or protein products of expression are considered active antisense compounds. In one embodiment, the antisense compounds of the invention target ACC1 and/or ACC2 causing a reduction of target RNA by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100%. It is understood that the compounds of the invention may reduce the expression level of ACC1 RNA, ACC2 RNA, or both to such a degree.

For example, the reduction of ACC1 or ACC2 expression can be measured in a tissue or organ of the animal. Tissues or organs include, but are not limited to, skeletal muscle, liver, kidney, and adipose (white and brown). Samples of tissues or organs can be routinely obtained by biopsy.

The cells contained within said fluids, tissues or organs being analyzed can contain a nucleic acid molecule encoding ACC1 or ACC2 protein and/or the ACC1- or ACC2-encoded protein itself. For example, tissues or organs procured from an animal can be evaluated for levels of the target mRNA or protein. mRNA levels can be measured or evaluated by real-time PCR, Northern blot, in situ hybridization or DNA array analysis. Protein levels can be measured or evaluated by ELISA, immunoblotting, quantitative protein assays, protein activity assays (for example, caspase activity assays) immunohistochemistry or immunocytochemistry. Furthermore, the effects of treatment can be assessed by measuring biomarkers associated with the target gene expression in the aforementioned tissues or organs or bodily fluids such as blood, collected from an animal contacted with one or more compounds of the invention, by routine clinical methods known in the art. These biomarkers include but are not limited to: glucose, cholesterol, lipoproteins, triglycerides, free fatty acids, and other markers of glucose and lipid metabolism; liver transaminases, bilirubin, albumin, blood urea nitrogen, creatine, and other markers of kidney and liver function.

The compounds of the present invention can be utilized in pharmaceutical compositions by adding an effective amount of a compound to a suitable pharmaceutically acceptable diluent or carrier. In one aspect, the compounds of the present invention decrease expression of ACC1 or ACC2. In preferred aspect, the compounds of the invention decrease expression of both ACC1 and ACC2. The compounds of the invention can also be used in the manufacture of a medicament for the treatment of diseases and disorders treatable by reducing ACC1 or ACC2 expression.

Another embodiment of the present invention is a method of decreasing expression of ACC1 or ACC2 or both wherein expression of ACC1 and ACC2 are not decreased in the central nervous system. Another embodiment of the present invention is a method of decreasing expression of ACC1 or ACC2 or both wherein expression of ACC1 and ACC2 are not decreased in the pancreas. Another embodiment of the present invention is a method of decreasing expression of ACC1 or ACC2 or both wherein expression of ACC1 and ACC2 are not decreased in the islet cells of the pancreas. Other embodiments of the invention include ameliorating or lessening the severity of a condition in an animal by administering an antisense compound which decreases expression of ACC1 or ACC2 or both wherein food intake is not increased. Other embodiments of the invention include ameliorating or lessening the severity of a condition in an animal by administering an antisense compound which decreases expression of ACC1 or ACC2 or both wherein appetite is not increased. In a preferred embodiment, expression of both ACC1 and ACC2 are decreased. Contemplated herein is use of an antisense oligonucleotide of the invention in the preparation of a medicament for ameliorating or lessening the severity of a condition in an animal wherein said condition is treatable by reducing expression of ACC1, ACC2, or both.

Other embodiments of the present invention are methods of lowering plasma lipid levels in an animal by administering an antisense compound which decreases expression of ACC1 or ACC2 or both. Plasma lipids include, but are not limited to, fatty acids, triglycerides, cholesterol, LDL, and VLDL. Contemplated herein is use of an antisense oligonucleotide of the invention in the preparation of a medicament to lower plasma lipid levels in an animal.

Another embodiment of the present invention is a method of lowering liver triglyceride levels in an animal by administering an antisense compound which decreases expression of ACC1 or ACC2 or both ACC1 and ACC2. Contemplated herein is use of an antisense oligonucleotide of the invention in the preparation of a medicament to lower liver triglyceride levels in an animal. NAFLD encompasses a disease spectrum ranging from simple triglyceride accumulation in hepatocytes (hepatic steatosis) to hepatic steatosis with inflammation (steatohepatitis), fibrosis, and cirrhosis. NAFLD can progress to NASH. Therefore, other embodiments of the present invention include ameliorating hepatic steatosis in an animal by administering an antisense compound which decreases expression of ACC1 or ACC2 or, preferably, both. The hepatic steatosis may be NAFLD, steatohepatitis, or NASH. Contemplated herein is use of an antisense oligonucleotide of the invention in the preparation of a medicament to treat hepatic steatosis in an animal. In some embodiments, the steatosis is NAFLD, steatohepatitis, or NASH.

Another embodiment of the present invention is a method of reducing adiposity in an animal in need thereof by administering an antisense compound which decreases expression of ACC1 or ACC2 or both. Indicators of reduction of adiposity of an animal include, but are not limited to, decreases in body fat. Another embodiment of the present invention is a method of ameliorating or lessening the severity of obesity in an animal by administering an antisense compound which decreases expression of ACC1 or ACC2 or both. Another embodiment of the present invention is a method of ameliorating or lessening the severity of diet-induced obesity in an animal by administering an antisense compound which decreases expression of ACC1 or ACC2 or both. Contemplated herein is use of an antisense oligonucleotide of the invention in the preparation of a medicament to treat obesity in an animal. In one embodiment, the medicament is used to reduce body fat in an animal. In other embodiment, the obesity is diet-induced.

Other embodiments of the present invention include, but are not limited to, methods of lowering plasma glucose and methods of lowering plasma triglyceride levels in an animal by administering an antisense compound which decreases expression of ACC1 or ACC2 or both. Provided herein is use of an antisense oligonucleotide of the invention in the preparation of a medicament to lower blood glucose or plasma triglycerides in an animal. Other embodiments include, but are not limited to, methods of improving insulin or leptin sensitivity in an animal by administering an antisense compound which decreases ACC1 or ACC2 expression selectively, or ACC1 and ACC2 expression concurrently. Provided herein is use of an antisense oligonucleotide of the invention in the preparation of a medicament to improve insulin or leptin sensitivity in an animal. In one embodiment, improved insulin sensitivity results in consequent reduction in insulin levels. In one embodiment improved insulin sensitivity is measured by a reduction in insulin. Other embodiments include, but are not limited to, methods of increasing fatty acid oxidation, methods of decreasing fatty acid synthesis, and methods of inhibiting hepatic glucose output in an animal by administering an antisense compound which decreases expression of ACC1 or ACC2 or both. Provided herein is use of an antisense oligonucleotide of the invention in the preparation of a medicament which increases fatty acid oxidation, decreases fatty acid synthesis or inhibits hepatic glucose output. Another embodiment includes methods of reducing hepatic malonyl-CoA levels in an animal by administering an antisense compound which decreases expression of ACC1 or ACC2 or both. Another embodiment includes methods of reducing malonyl-CoA levels in lipogenic or oxidative tissues in an animal by administering an antisense compound which decreases expression of ACC1 or ACC2 or both. Another embodiment includes improvement of hepatic insulin sensitivity in an animal by administering an antisense compound which decreases expression of ACC1 or ACC2 or both. Provided herein is use of an antisense oligonucleotide of the invention in the preparation of a medicament for improving insulin sensitivity in an animal. Another embodiment is a method of improving plasma ketone levels in an animal by administering an antisense compound which decreases expression of ACC1 or ACC2 or both. Plasma ketones include 3-betahydroxybutarate, acetone, and acetoacetate. Another embodiment is a method of increasing hepatic fat oxidation in an animal by administering an antisense compound which decreases expression of ACC1 or ACC2 or both.

Other embodiments of the invention include ameliorating or lessening the severity of a condition in an animal by administering an antisense compound which decreases expression of ACC1 or ACC2 or both. Conditions include, but are not limited to, metabolic and cardiovascular disorders. Metabolic disorders include, but are not limited to, obesity, diet-induced obesity, diabetes, insulin resistance, insulin deficiency, dyslipidemia, hypercholesterolemia, hyperglycemia, hypertriglyceridemia, hyperfattyacidemia, liver steatosis and metabolic syndrome. Cardiovascular disorders include, but are not limited to, coronary heart disease. Provided herein is use of an antisense oligonucleotide of the invention in the preparation of a medicament for preventing or treating a metabolic or cardiovascular disorder. Contemplated herein is use of an antisense oligonucleotide of the invention for amelioration or treatment of a condition selected from obesity, diabetes, insulin resistance, insulin deficiency, hypercholesterolemia, hyperglycemia, hypertriglyceridemia, hyperfattyacidemia, liver steatosis, metabolic syndrome, or cardiovascular disease.

Contemplated herein is use of an antisense oligonucleotide of the invention for amelioration or treatment of a condition selected from obesity, diabetes, insulin resistance, insulin deficiency, hypercholesterolemia, hyperglycemia, hypertriglyceridemia, hyperfattyacidemia, liver steatosis, metabolic syndrome, or cardiovascular disease wherein said condition is treatable by reducing ACC1 and ACC2 expression.

Targets

As used herein, the terms "target nucleic acid" and "nucleic acid molecule encoding ACC1 or ACC2" have been used for convenience to encompass RNA (including pre-mRNA and mRNA or portions thereof) transcribed from DNA encoding ACC1 or ACC2, and also cDNA derived from such RNA.

The locations on the target nucleic acid to which active antisense compounds are complementary are hereinbelow referred to as "validated target segments." As used herein the term "validated target segment" is defined as at least a portion of a target region to which an active antisense compound is targeted. While not wishing to be bound by theory, it is presently believed that these target segments represent portions of the target nucleic acid which are accessible for hybridization.

Regions, Segments, and Sites

The targeting process usually also includes determination of at least one target region, segment, or site within the target nucleic acid for the antisense interaction to occur such that the desired effect, e.g., reduction of expression of ACC1 or ACC2 or both, will result. "Region" is defined as a portion of the target nucleic acid having at least one identifiable structure, function, or characteristic. Within regions of target nucleic acids are segments. "Segments" are defined as smaller or sub-portions of regions within a target nucleic acid. "Sites," as used in the present invention, are defined as unique nucleobase positions within a target nucleic acid.

Once one or more target regions, segments or sites have been identified, antisense compounds are designed which are sufficiently complementary to the target, i.e., hybridize with sufficient affinity and specificity to give the desired effect.

Target segments can include DNA or RNA sequences that comprise at least a portion of consecutive nucleobases from the 5'-terminus of a validated target segment (the remaining nucleobases being a consecutive stretch of the same DNA or RNA beginning immediately upstream of the 5'-terminus of the target segment and continuing until the DNA or RNA contains the desired number of nucleobases). Similarly validated target segments are represented by DNA or RNA sequences that comprise at least a portion of consecutive nucleobases from the 3'-terminus of a validated target segment (the remaining nucleobases being a consecutive stretch of the same DNA or RNA beginning immediately downstream of the 3'-terminus of the target segment and continuing until the DNA or RNA contains the desired number of nucleobases). It is also understood that a validated oligomeric target segment can be represented by DNA or RNA sequences that comprise at least a portion of consecutive nucleobases from an internal portion of the sequence of a validated target segment, and can extend in either or both directions until the oligonucleotide contains the desired number of nucleobases. Alternatively, target segments can include at least 8, 9, 10, 11, 12, 13, 14, 15, 16, 17, 18, or 19 consecutive nucleobases of a validated target segment, for example, as counted from the 5' or 3' terminus or from an internal site of a validated target segment. Therefore, oligonucleotides encompassed by the invention may comprise at least 8, 9, 10, 11, 12, 13, 14, 15, 16, 17, 18, or 19 consecutive nucleobases of an oligonucleotide exemplified herein. Preferred are oligonucleotides which comprise at least a 13 nucleobase portion of an exemplified antisense oligonucleotide. Also preferred are oligonucleotides which comprise at least an 8 nucleobase portion of an exemplified antisense oligonucleotide.

The validated target segments identified herein can be employed in a screen for additional compounds that modulate ACC1 or ACC2. The screening method comprises the steps of contacting a validated target segment of a nucleic acid molecule encoding ACC1 or ACC2 with one or more candidate modulators, and selecting for one or more candidate modulators which increase or decrease levels of a nucleic acid molecule encoding ACC1 or ACC2. Once it is shown that the candidate modulator or modulators are capable of such alteration of levels of a nucleic acid molecule encoding ACC1 or ACC2, the modulator can then be employed in further investigative studies of the function of ACC1 or ACC2, or for use as a research, diagnostic, or therapeutic agent.

The target regions to which the exemplified compounds are inhibitory are described herein by indicating the 5'-most position on the target nucleic acid. Coupled with the length of the exemplified compound, the target region for the exemplified compound is described. For example, the antisense compound having SEQ ID NO: 210 targets nucleotides 1932 to 1951 of the ACC2 sequence NM_133904.1. As shown in the examples herein, the oligonucleotide reduces ACC2, thus nucleotides 1932 to 1951 is a validated target segment of NM 133904.1. Because compounds of the invention may be, for example, 13 to 30 nucleobases in length, and may comprise, for example, a 13 nucleobase portion of an exemplified sequence, it can be appreciated that a compound within the scope of the invention may target any portion of nucleotides 1915 to 1968 of NM_133904.1. As a further example, a 30-mer targeting nucleotides 1915 to 1944 of NM_133904.1 and comprising a 13-nucleobase portion of SEQ ID NO: 210 would still fall within the scope of the invention described herein.

The start codon and stop codon in mRNA molecules and their corresponding DNA molecules are readily identifiable to those of skill in the art. "Start codon region" or "stop codon region" as used herein refers to the portion of an mRNA or gene that encompasses from about 25 to about 50 contiguous nucleotides in either direction (i.e., 5' or 3') from a start or stop codon. Consequently, the "start codon region" and the "stop codon region" are all regions which may be targeted effectively with antisense compounds of the invention.

The open reading frame (ORF) or "coding region," which is known in the art to refer to the region between the translation initiation codon and the translation termination codon, is also a region which may be targeted effectively. Within the context of the present invention, one region is the intragenic region encompassing the translation initiation or termination codon of the open reading frame (ORF) of a gene.

Other target regions include the "5' untranslated region" (5'UTR) and the "3' untranslated region" (3'UTR). The 5' cap region of an mRNA is considered to include the 5' cap structure itself as well as the first 50 nucleotides adjacent to the cap site. The 5' cap region is also a target.

Suitable target regions thus include, but are not limited to, the 5'UTR, the start codon, the stop codon, the coding region, the 3'UTR, the 5'cap region, introns, exons, intron-exon junctions, exon-intron junctions, and exon-exon junctions. Suitable target regions encompass from about 25 to about 50 nucleotides in either direction (i.e. 5' or 3') of a junction site.

Variants

It is also known in the art that alternative RNA transcripts can be produced from the same genomic region of DNA. These alternative transcripts are generally known as "variants." More specifically, "pre-mRNA variants" are transcripts produced from the same genomic DNA that differ from other transcripts produced from the same genomic DNA in either their start or stop position and contain both intronic and exonic sequence.

Upon excision of one or more exon or intron regions, or portions thereof during splicing, pre-mRNA variants produce smaller "mRNA variants." Consequently, mRNA variants are processed pre-mRNA variants and each unique pre-mRNA variant must always produce a unique mRNA variant as a result of splicing. These mRNA variants are also known as "alternative splice variants." If no splicing of the pre-mRNA variant occurs then the pre-mRNA variant is identical to the mRNA variant.

It is also known in the art that variants can be produced through the use of alternative signals to start or stop transcription and that pre-mRNAs and mRNAs can possess more that one start codon or stop codon. Variants that originate from a pre-mRNA or mRNA that use alternative start codons are known as "alternative start variants" of that pre-mRNA or mRNA. Those transcripts that use an alternative stop codon are known as "alternative stop variants" of that pre-mRNA or mRNA. One specific type of alternative stop variant is the "polyA variant" in which the multiple transcripts produced result from the alternative selection of one of the "polyA stop signals" by the transcription machinery, thereby producing transcripts that terminate at unique polyA sites. Consequently, the types of variants described herein are also suitable target nucleic acids.

Modulation of Target Expression

"Modulation" means a perturbation of function, for example, either an increase (stimulation or induction) or a decrease (inhibition or reduction) in expression or in level of target RNA. As another example, modulation of expression can include perturbing splice site selection of pre-mRNA processing. "Expression" includes all the functions by which a gene's coded information is converted into structures present and operating in a cell. These structures include the products of transcription and translation. "Modulation of expression" means the perturbation of such functions. "Modulators" are those compounds that modulate the expression of ACC1 or ACC2 and which comprise at least a portion which is complementary to a validated target segment.

Modulation of expression of a target nucleic acid can be achieved through alteration of any number of nucleic acid functions. The functions of RNA to be modulated can include translocation functions, which include, but are not limited to, translocation of the RNA to a site of protein translation, translocation of the RNA to sites within the cell which are distant from the site of RNA synthesis, and translation of protein from the RNA. RNA processing functions that can be modulated include, but are not limited to, splicing of the RNA to yield one or more RNA species, capping of the RNA, 3' maturation of the RNA and catalytic activity or complex formation involving the RNA which may be engaged in or facilitated by the RNA. Modulation of expression can result in the increased level of one or more nucleic acid species or the decreased level of one or more nucleic acid species, either temporally or by net steady state level. One result of such interference with target nucleic acid function is modulation of the expression of ACC1 or ACC2 or both ACC1 and ACC2. Thus, in one embodiment modulation of expression can mean increase or decrease in target RNA or protein levels. In another embodiment modulation of expression can mean an increase or decrease of one or more RNA splice products, or a change in the ratio of two or more splice products.

Hybridization and Complementarity

"Hybridization" means the pairing of complementary strands of antisense compounds. While not limited to a particular mechanism, the most common mechanism of pairing involves hydrogen bonding, which may be Watson-Crick, Hoogsteen or reversed Hoogsteen hydrogen bonding, between complementary nucleoside or nucleotide bases (nucleobases) of the strands of antisense compounds. For example, adenine and thymine are complementary nucleobases which pair through the formation of hydrogen bonds. Hybridization can occur under varying circumstances. An antisense compound is "specifically hybridizable" when there is a sufficient degree of complementarity to avoid non-specific binding of the antisense compound to non-target nucleic acid sequences under conditions in which specific binding is desired, i.e., under physiological conditions in the case of in vivo assays or therapeutic treatment, and under conditions in which assays are performed in the case of in vitro assays.

"Complementarity," as used herein, refers to the capacity for precise pairing between two nucleobases on one or two antisense compound strands. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be a complementary position. The antisense compound and the further DNA or RNA are complementary to each other when a sufficient number of complementary positions in each molecule are occupied by nucleobases which can hydrogen bond with each other. Thus, "specifically hybridizable" and "complementary" are terms which are used to indicate a sufficient degree of precise pairing or complementarity over a sufficient number of nucleobases such that stable and specific binding occurs between the antisense compound and a target nucleic acid to allow the compound to function.

It is understood in the art that the sequence of an antisense compound need not be 100% complementary to that of its target nucleic acid to be specifically hybridizable or to be encompassed by the present invention. One of ordinary skill in the art will appreciate that complementarity less than 100% to a target nucleic acid or to a validated target segment within such a nucleic acid renders the compound with mismatches, thus, compounds having mismatches fall within the scope of the invention. Preferred oligonucleotides have fewer than about 3 mismatches.

Moreover, an oligonucleotide may hybridize over one or more segments such that intervening or adjacent segments are not involved in the hybridization event (e.g., a loop structure, mismatch or hairpin structure). The antisense compounds of the present invention comprise at least 70%, or at least 75%, or at least 80%, or at least 85%, or at least 90%, or at least 92%, or at least 95%, or at least 97%, or at least 98%, or at least 99% sequence complementarity to a target region within the target nucleic acid sequence to which they are targeted.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489).

An antisense compound with complementarity to both ACC1 and ACC2 is considered to fall within the scope of the present invention. For example, an oligonucleotide which is 100% complementarity to ACC1 but has 85% complementarity or 3 mismatches to ACC2 (thus having 17 of 20 nucleotides which are complementary to the target site) is contemplated herein. Likewise, an oligonucleotide having 85% complementarity to both ACC1 and ACC2 is contemplated. Also contemplated are oligonucleotides having 100% complementarity to both ACC1 and ACC2. Preferred embodiments of the present invention include oligonucleotides having sufficient complementarity to ACC1 and ACC2 to cause a reduction in expression in both ACC1 and ACC2.

One of ordinary skill in the art will appreciate that a routine alignment of ACC1 and ACC2 sequences (such as an alignment performed by BLAST or other readily available programs) will show regions suitable for design of oligonucleotides targeting ACC1 and ACC2 independently or simultaneously.

Antisense Mechanisms and Compounds

"Antisense mechanisms" are all those involving hybridization of a compound with target nucleic acid, wherein the outcome or effect of the hybridization is either target degradation or target occupancy with concomitant stalling of the cellular machinery involving, for example, transcription or splicing. Such mechanisms are appreciated in the art and include, for example, RNase-H and RNAi-based mechanisms.

The term "antisense compound" refers to a polymeric structure capable of hybridizing to a region of a nucleic acid molecule. This term includes oligonucleotides, oligonucleosides, oligonucleotide analogs, oligonucleotide mimetics and chimeric combinations of these. Antisense compounds are routinely prepared linearly but can be joined or otherwise prepared to be circular. Moreover, branched structures are known in the art. An "antisense compound" or "oligomeric antisense compound" refers to an antisense compound that is at least partially complementary to the region of a nucleic acid molecule to which it hybridizes and which modulates (increases or decreases) its expression. Consequently, while all antisense compounds can be said to be oligomeric compounds, not all oligomeric compounds are antisense compounds. An "antisense oligonucleotide" is an antisense compound that is a nucleic acid-based oligomer. An antisense oligonucleotide can be chemically modified. Nonlimiting examples of antisense compounds include primers, probes, antisense compounds, antisense oligonucleotides, external guide sequence (EGS) oligonucleotides, alternate splicers, and siRNAs. As such, these compounds can be introduced in the form of single-stranded, double-stranded, circular, branched or hairpins and can contain structural elements such as internal or terminal bulges or loops. Double-stranded compounds can be comprised of two strands hybridized to form double-stranded compounds or a single strand with sufficient self complementarity to allow for hybridization and formation of a fully or partially double-stranded compound. In a preferred embodiment, the compounds of the instant invention are non-autocatalytic.

"Chimeric" antisense compounds or "chimeras," in the context of this invention, are single-or double-stranded antisense compounds, such as oligonucleotides, which contain two or more chemically distinct regions, each comprising at least one monomer unit, i.e., a nucleotide in the case of an oligonucleotide compound.

A "gapmer" is defined as an antisense compound, generally an oligonucleotide, having a 2'-deoxyoligonucleotide region flanked by non-deoxyoligonucleotide segments. The central region is referred to as the "gap." The flanking segments are referred to as "wings." If one of the wings has zero non-deoxyoligonucleotide monomers, a "hemimer" is described.

In one embodiment of the invention, double-stranded antisense compounds encompass short interfering RNAs (siRNAs). As used herein, the term "siRNA" is defined as a double-stranded compound having a first and second strand, each strand having a central portion and two independent terminal portions. The central portion of the first strand is complementary to the central portion of the second strand, allowing hybridization of the strands. The terminal portions are independently, optionally complementary to the corresponding terminal portion of the complementary strand. The ends of the strands may be modified by the addition of one or more natural or modified nucleobases to form an overhang. In one nonlimiting example, the first strand of the siRNA is antisense to the target nucleic acid, while the second strand is complementary to the first strand. Once the antisense strand is designed to target a particular nucleic acid target, the sense strand of the siRNA can then be designed and synthesized as the complement of the antisense strand and either strand may contain modifications or additions to either terminus. For example, in one embodiment, both strands of the siRNA duplex would be complementary over the central nucleobases, each having overhangs at one or both termini. It is possible for one end of a duplex to be blunt and the other to have overhanging nucleobases. In one embodiment, the number of overhanging nucleobases is from 1 to 6 on the 3' end of each strand of the duplex. In another embodiment, the number of overhanging nucleobases is from 1 to 6 on the 3' end of only one strand of the duplex. In a further embodiment, the number of overhanging nucleobases is from 1 to 6 on one or both 5' ends of the duplexed strands. In another embodiment, the number of overhanging nucleobases is zero. In a preferred embodiment, each of the strands is 19 nucleobases in length, fully hybridizable with the complementary strand, and includes no overhangs.

Each strand of the siRNA duplex may be from about 12 to about 35 nucleobases. In a preferred embodiment, each strand of the siRNA duplex is about 17 to about 25 nucleobases. The central complementary portion may be from about 12 to about 35 nucleobases in length. In a preferred embodiment, the central complimentary portion is about 17 to about 25 nucleobases in length. It is understood that each the strand of the siRNA duplex and the central complementary portion may be about 12, 13, 14, 15, 16, 17, 18, 19, 20, 21, 22, 23, 24, 25, 26, 27, 28, 29, 30, 31, 32, 33, 34, or 35 nucleobases in length. The terminal portions can be from 1 to 6 nucleobases. It is understood that the terminal portions can be about 1, 2, 3, 4, 5, or 6 nucleobases in length. The siRNAs may also have no terminal portions. The two strands of an siRNA can be linked internally leaving free 3' or 5' termini, or can be linked to form a continuous hairpin structure or loop. The hairpin structure may contain an overhang on either the 5' or 3' terminus producing an extension of single-stranded character.

Double-stranded compounds can be made to include chemical modifications as discussed herein.

Chemical Modifications

Embodiments of the present invention include compounds comprising at least two modifications selected from a modified internucleoside linkage, a modified nucleobase, or a modified sugar. In one embodiment, the antisense compounds of the present invention are chimeric oligonucleotides. In one embodiment, the antisense compounds of the present invention are chimeric oligonucleotides comprising a deoxy nucleotide region flanked on each of the 5' and 3' ends with at least one 2'-O-(2-methoxyethyl) nucleotide. In another embodiment, the antisense compounds of the present invention are chimeric oligonucleotides comprising ten deoxynucleotides and flanked on both the 5' and 3' ends with five 2'-O-(2-methoxyethyl) nucleotides. In a further embodiment, the antisense compounds of the present invention may have at least one 5-methylcytosine.

As is known in the art, a nucleoside is a base-sugar combination. The base portion of the nucleoside is normally a heterocyclic base (sometimes referred to as a "nucleobase" or simply a "base"). The two most common classes of such heterocyclic bases are the purines and the pyrimidines. Nucleotides are nucleosides that further include a phosphate group covalently linked to the sugar portion of the nucleoside. For those nucleosides that include a pentofuranosyl sugar, the phosphate group can be linked to the 2',3' or 5' hydroxyl moiety of the sugar. In forming oligonucleotides, the phosphate groups covalently link adjacent nucleosides to one another to form a linear polymeric compound. In turn, the respective ends of this linear polymeric compound can be further joined to form a circular compound. Within oligonucleotides, the phosphate groups are commonly referred to as forming the internucleoside backbone of the oligonucleotide. The normal linkage or backbone of RNA and DNA is a 3' to 5' phosphodiester linkage. It is often preferable to include chemical modifications in oligonucleotides to alter their activity. Chemical modifications can alter oligonucleotide activity by, for example: increasing affinity of an antisense oligonucleotide for its target RNA, increasing nuclease resistance, and/or altering the pharmacokinetics of the oligonucleotide. The use of chemistries that increase the affinity of an oligonucleotide for its target can allow for the use of shorter oligonucleotide compounds.

The term "nucleobase" or "heterocyclic base moiety" as used herein, refers to the heterocyclic base portion of a nucleoside. In general, a nucleobase is any group that contains one or more atom or groups of atoms capable of hydrogen bonding to a base of another nucleic acid. In addition to "unmodified" or "natural" nucleobases such as the purine nucleobases adenine (A) and guanine (G), and the pyrimidine nucleobases thymine (T), cytosine (C) and uracil (U), many modified nucleobases or nucleobase mimetics known to the art skilled are amenable to the present invention. The terms modified nucleobase and nucleobase mimetic can overlap but generally a modified nucleobase refers to a nucleobase that is fairly similar in structure to the parent nucleobase such as for example a 7-deaza purine or a 5-methylcytosine whereas a nucleobase mimetic would include more complicated structures such as for example a tricyclic phenoxazine nucleobase mimetic. Methods for preparation of the above noted modified nucleobases are well known to those skilled in the art.

Antisense compounds of the present invention may also contain one or more nucleosides having modified sugar moieties. The furanosyl sugar ring of a nucleoside can be modified in a number of ways including, but not limited to, addition of a substituent group, bridging of two non-germinal ring atoms to form a bicyclic nucleic acid (BNA) and substitution of an atom or group such as —S—, —N(R)— or —C(R1)(R2) for the ring oxygen at the 4'-position. Modified sugar moieties are well known and can be used to alter, typically increase, the affinity of the antisense compound for its target and/or increase nuclease resistance. A representative list of preferred modified sugars includes but is not limited to bicyclic modified sugars (BNA's), including LNA and ENA (4'-(CH2)2-O-2' bridge); and substituted sugars, especially 2'-substituted sugars having a 2'-F, 2'-OCH2 or a 2'-O(CH2) 2-OCH3 substituent group. Sugars can also be replaced with sugar mimetic groups among others. Methods for the preparations of modified sugars are well known to those skilled in the art.

The present invention includes internucleoside linking groups that link the nucleosides or otherwise modified monomer units together thereby forming an antisense compound. The two main classes of internucleoside linking groups are defined by the presence or absence of a phosphorus atom. Representative phosphorus containing internucleoside linkages include, but are not limited to, phosphodiesters, phosphotriesters, methylphosphonates, phosphoramidate, and phosphorothioates. Representative non-phosphorus containing internucleoside linking groups include, but are not limited to, methylenemethylimino (—CH2-N(CH3)-O—CH2-), thiodiester (—O—C(O)—S—), thionocarbamate (—O—C(O)(NH)—S—); siloxane (—O—Si(H)2-O—); and N,N'-dimethylhydrazine (—CH2-N(CH3)-N(CH3)-). Antisense compounds having non-phosphorus internucleoside linking groups are referred to as oligonucleosides. Modified internucleoside linkages, compared to natural phosphodiester linkages, can be used to alter, typically increase, nuclease resistance of the antisense compound. Internucleoside linkages having a chiral atom can be prepared racemic, chiral, or as a mixture. Representative chiral internucleoside linkages include, but are not limited to, alkylphosphonates and phosphorothioates. Methods of preparation of phosphorous-containing and non-phosphorous-containing linkages are well known to those skilled in the art.

As used herein the term "mimetic" refers to groups that are substituted for a sugar, a nucleobase, and/or internucleoside linkage. Mimetics are groups that are structurally quite different (not simply a modification) but functionally similar to the linked nucleosides of oligonucleotides. Generally, a mimetic is used in place of the sugar or sugar-internucleoside linkage combination, and the nucleobase is maintained for hybridization to a selected target. Representative examples of a sugar mimetic include, but are not limited to, cyclohexenyl or morpholino. Representative examples of a mimetic for a sugar-internucleoside linkage combination include, but are not limited to, peptide nucleic acids (PNA) and morpholino groups linked by uncharged achiral linkages. In some instances a mimetic is used in place of the nucleobase. Representative nucleobase mimetics are well known in the art and include, but are not limited to, tricyclic phenoxazine analogs and universal bases (Berger et al., Nuc Acid Res. 2000, 28:2911-14, incorporated herein by reference). Methods of synthesis of sugar, nucleoside and nucleobase mimetics are well known to those skilled in the art.

As used herein the term "nucleoside" includes, nucleosides, abasic nucleosides, modified nucleosides, and nucleosides having mimetic bases and/or sugar groups.

In the context of this invention, the term "oligonucleotide" refers to an antisense compound which is an oligomer or polymer of ribonucleic acid (RNA) or deoxyribonucleic acid (DNA). This term includes oligonucleotides composed of naturally- and non-naturally-occurring nucleobases, sugars and covalent internucleoside linkages, possibly further including non-nucleic acid conjugates.

The present invention provides compounds having reactive phosphorus groups useful for forming internucleoside linkages including for example phosphodiester and phosphorothioate internucleoside linkages. Methods of preparation and/or purification of precursors or olgomeric compounds of the instant invention are not a limitation of the compositions or methods of the invention. Methods for synthesis and purification of DNA, RNA, and the antisense compounds of the instant invention are well known to those skilled in the art.

As used herein the term "chimeric antisense compound" refers to an antisense compound having at least one sugar, nucleobase and/or internucleoside linkage that is differentially modified as compared to the other sugars, nucleobases and internucleoside linkages within the same antisense compound. The remainder of the sugars, nucleobases and internucleoside linkages can be independently modified or unmodified provided that they are distinguishable from the differentially modified moiety or moieties. In general a chimeric antisense compound will have modified nucleosides that can be in isolated positions or grouped together in regions that will define a particular motif. Any combination of modifications and or mimetic groups can comprise a chimeric antisense compound of the present invention.

Chimeric antisense compounds typically contain at least one region modified so as to confer increased resistance to nuclease degradation, increased cellular uptake, and/or increased binding affinity for the target nucleic acid. An additional region of the antisense compound may serve as a substrate for enzymes capable of cleaving RNA:DNA or RNA:RNA hybrids. By way of example, RNase H is a cellular endonuclease that cleaves the RNA strand of an RNA:DNA duplex. Activation of RNase H, therefore, results in cleavage of the RNA target, thereby greatly enhancing the efficiency of inhibition of gene expression. Consequently, comparable results can often be obtained with shorter antisense compounds when chimeras are used, compared to for example phosphorothioate deoxyoligonucleotides hybridizing to the same target region. Cleavage of the RNA target can be routinely detected by gel electrophoresis and, if necessary, associated nucleic acid hybridization techniques known in the art.

Certain chimeric as well as non-chimeric antisense compounds can be further described as having a particular motif. As used in the present invention the term "motif" refers to the orientation of modified sugar moieties and/or sugar mimetic groups in an antisense compound relative to like or differentially modified or unmodified nucleosides. As used in the present invention, the terms "sugars", "sugar moieties" and "sugar mimetic groups" are used interchangeably. Such motifs include, but are not limited to, gapped motifs, alternating motifs, fully modified motifs, hemimer motifs, blockmer motifs, and positionally modified motifs. The sequence and the structure of the nucleobases and type of internucleoside linkage is not a factor in determining the motif of an antisense compound.

In one aspect of the present invention antisense compounds are modified by covalent attachment of one or more conjugate groups. Conjugate groups may be attached by reversible or irreversible attachments. Conjugate groups may be attached directly to antisense compounds or by use of a linker. Linkers may be mono- or bifunctional linkers. Such attachment methods and linkers are well known to those skilled in the art. In general, conjugate groups are attached to antisense compounds to modify one or more properties. Such considerations are well known to those skilled in the art.

NAFLD and Metabolic Syndrome

The term "nonalcoholic fatty liver disease" (NAFLD) encompasses a disease spectrum ranging from simple triglyceride accumulation in hepatocytes (hepatic steatosis) to hepatic steatosis with inflammation (steatohepatitis), fibrosis, and cirrhosis. Nonalcoholic steatohepatitis (NASH) occurs from progression of NAFLD beyond deposition of triglycerides. A second-hit capable of inducing necrosis, inflammation, and fibrosis is required for development of NASH. Candidates for the second-hit can be grouped into broad categories: factors causing an increase in oxidative stress and factors promoting expression of proinflammatory cytokines. It has been suggested that increased liver triglycerides lead to increased oxidative stress in hepatocytes of animals and humans, indicating a potential cause-and-effect relationship between hepatic triglyceride accumulation, oxidative stress, and the progression of hepatic steatosis to NASH (Browning and Horton, J. Clin. Invest., 2004, 114, 147-152). Hypertriglyceridemia and hyperfattyacidemia can cause triglyceride accumulation in peripheral tissues (Shimamura et al., Biochem. Biophys. Res. Commun., 2004, 322, 1080-1085).

"Metabolic syndrome" is defined as a clustering of lipid and non-lipid cardiovascular risk factors of metabolic origin. It is closely linked to the generalized metabolic disorder known as insulin resistance. The National Cholesterol Education Program (NCEP) Adult Treatment Panel III (ATPIII) established citeria for diagnosis of metabolic syndrome when three or more of five risk determinants are present. The five risk determinants are abdominal obesity defined as waist circumference of greater than 102 cm for men or greater than 88 cm for women, triglyceride levels greater than or equal to 150 mg/dL, HDL cholesterol levels of less than 40 mg/dL for men and less than 50 mg/dL for women, blood pressure greater than or equal to 130/85 mm Hg and fasting glucose levels greater than or equal to 110 mg/dL. These determinants can be readily measured in clinical practice (JAMA, 2001, 285, 2486-2497).

Combinations

Compositions of the invention can contain two or more antisense compounds. In another related embodiment, compositions of the present invention can contain one or more antisense compounds, particularly oligonucleotides, targeted to a first nucleic acid and one or more additional antisense compounds targeted to a second nucleic acid target. Alternatively, compositions of the present invention can contain two or more antisense compounds targeted to different regions of the same nucleic acid target. Two or more combined compounds may be used together or sequentially.

Combination Therapy

Compounds of the invention may be used in combination therapies wherein an additive effect is achieved by administering one or more compounds of the invention and one or more other suitable therapeutic/prophylactic compounds to treat a condition. One or more of the therapeutic/prophylactic compounds may be combined with one or more of the antisense inhibitors of ACC1 or ACC2 to achieve an additive therapeutic effect.

Oligomer Synthesis

Oligomerization of modified and unmodified nucleosides can be routinely performed according to literature procedures for DNA (Protocols for Oligonucleotides and Analogs, Ed. Agrawal (1993), Humana Press) and/or RNA (Scaringe, Methods (2001), 23, 206-217. Gait et al., Applications of Chemically synthesized RNA in RNA: Protein Interactions, Ed. Smith (1998), 1-36. Gallo et al., Tetrahedron (2001), 57, 5707-5713).

Antisense compounds of the present invention can be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed. It is well known to use similar techniques to prepare oligonucleotides such as the phosphorothioates and alkylated derivatives. The invention is not limited by the method of oligomer synthesis.

Oligomer Purification and Analysis

Methods of oligonucleotide purification and analysis are known to those skilled in the art. Analysis methods include capillary electrophoresis (CE) and electrospray-mass spectroscopy. Such synthesis and analysis methods can be performed in multi-well plates. The method of the invention is not limited by the method of oligomer purification.

Nonlimiting Disclosure and Incorporation by Reference

While certain compounds, compositions and methods of the present invention have been described with specificity in accordance with certain embodiments, the examples herein serve only to illustrate the compounds of the invention and are not intended to limit the same. Each of the references, GEN-BANK® accession numbers, and the like recited in the present application is incorporated herein by reference in its entirety.

Example 1

Assaying Modulation

Modulation of ACC1 or ACC2 expression can be assayed in a variety of ways known in the art. ACC1 or ACC2 mRNA levels can be quantitated by, e.g., Northern blot analysis, competitive polymerase chain reaction (PCR), or real-time PCR. RNA analysis can be performed on total cellular RNA or poly(A)+mRNA by methods known in the art. Methods of RNA isolation are taught in, for example, Ausubel, F. M. et al., Current Protocols in Molecular Biology, Volume 1, pp. 4.1.1-4.2.9 and 4.5.1-4.5.3, John Wiley & Sons, Inc., 1993.

Northern blot analysis is routine in the art and is taught in, for example, Ausubel, F. M. et al., Current Protocols in Molecular Biology, Volume 1, pp. 4.2.1-4.2.9, John Wiley & Sons, Inc., 1996. Real-time quantitative (PCR) can be conveniently accomplished using the commercially available ABI PRISM™ 7700 Sequence Detection System, available from PE-Applied Biosystems, Foster City, Calif. and used according to manufacturer's instructions.

Levels of proteins encoded by ACC1 or ACC2 can be quantitated in a variety of ways well known in the art, such as immunoprecipitation, Western blot analysis (immunoblotting), ELISA or fluorescence-activated cell sorting (FACS). Antibodies directed to a protein encoded by ACC1 or ACC2 can be identified and obtained from a variety of sources, such as the MSRS catalog of antibodies (Aerie Corporation, Birmingham, Mich.), or can be prepared via conventional antibody generation methods. Methods for preparation of polyclonal antisera are taught in, for example, Ausubel, F. M. et al., Current Protocols in Molecular Biology, Volume 2, pp. 11.12.1-11.12.9, John Wiley & Sons, Inc., 1997. Preparation of monoclonal antibodies is taught in, for example, Ausubel, F. M. et al., Current Protocols in Molecular Biology, Volume 2, pp. 11.4.1-11.11.5, John Wiley & Sons, Inc., 1997.

Immunoprecipitation methods are standard in the art and can be found at, for example, Ausubel, F. M. et al., Current Protocols in Molecular Biology, Volume 2, pp. 10.16.1-10.16.11, John Wiley & Sons, Inc., 1998. Western blot (immunoblot) analysis is standard in the art and can be found at, for example, Ausubel, F. M. et al., Current Protocols in Molecular Biology, Volume 2, pp. 10.8.1-10.8.21, John Wiley & Sons, Inc., 1997. Enzyme-linked immunosorbent assays (ELISA) are standard in the art and can be found at, for example, Ausubel, F. M. et al., Current Protocols in Molecular Biology, Volume 2, pp. 11.2.1-11.2.22, John Wiley & Sons, Inc., 1991.

The effect of antisense compounds of the present invention on target nucleic acid expression can be tested in any of a variety of cell types provided that the target nucleic acid is present at measurable levels. The effect of antisense compounds of the present invention on target nucleic acid expression can be routinely determined using, for example, PCR or Northern blot analysis. Cell lines are derived from both normal tissues and cell types and from cells associated with various disorders (e.g. hyperproliferative disorders). Cell lines derived from muliple tissues and species can be obtained, for example, from American Type Culture Collection (ATCC, Manassas, Va.) or from the Japanese Cancer Research Resources Bank (Tokyo, Japan) or the Centre for Applied Microbiology and Research (Wiltshire, United Kingdom), respectively.

Primary cells, or those cells which are isolated from an animal and not subjected to continuous culture, can be prepared according to methods known in the art or obtained from various commercial suppliers. Additionally, primary cells include those obtained from donor human subjects in a clinical setting (i.e. blood donors, surgical patients). Primary cells may be prepared by methods known in the art or can be obtained from commercial suppliers such as Stem Cell Technologies; Zen-Bio, Inc. (Research Triangle Park, N.C.); Cambrex Biosciences (Walkersville, Md.); In Vitro Technologies (Baltimore, Md.); Cascade Biologics (Portland, Oreg.); Advanced Biotechnologies (Columbia, Md.).

Cell Types

The effect of antisense compounds on target nucleic acid expression was tested in the following cell types.

b.END:

The mouse brain endothelial cell line b.END was obtained from Dr. Werner Risau at the Max Plank Institute (Bad Nauheim, Germany). b.END cells were routinely cultured in DMEM, high glucose (Invitrogen Life Technologies, Carlsbad, Calif.) supplemented with 10% fetal bovine serum (Invitrogen Life Technologies, Carlsbad, Calif.). Cells were routinely passaged by trypsinization and dilution when they reached approximately 90% confluence. Cells were seeded into 96-well plates (Falcon-Primaria #353872, BD Biosciences, Bedford, Mass.) at a density of approximately 3000 cells/well for use in antisense compound transfection experiments.

A549:

The human lung carcinoma cell line A549 was obtained from the American Type Culture Collection (Manassas, Va.). A549 cells were routinely cultured in DMEM, high glucose (Invitrogen Life Technologies, Carlsbad, Calif.) supplemented with 10% fetal bovine serum, 100 units per ml penicillin, and 100 micrograms per ml streptomycin (Invitrogen Life Technologies, Carlsbad, Calif.). Cells were routinely passaged by trypsinization and dilution when they reached approximately 90% confluence. Cells were seeded into 96-well plates (Falcon-Primaria #3872) at a density of approximately 5000 cells/well for use in antisense compound transfection experiments.

Primary Mouse Hepatocytes:

Primary mouse hepatocytes were prepared via routine procedures from CD-1 mice purchased from Charles River Labs. Primary mouse hepatocytes were routinely cultured in Hepatocyte Attachment Media supplemented with 10% fetal bovine serum, 1% penicillin/streptomycin, 1% antibiotic-antimitotic (Invitrogen Life Technologies, Carlsbad, Calif.) and 10 nM bovine insulin (Sigma-Aldrich, St. Louis, Mo.). Cells were seeded into 96-well plates (Falcon-Primaria #353872, BD Biosciences, Bedford, Mass.) coated with 0.1 mg/ml collagen at a density of approximately 10,000 cells/well for use in antisense compound transfection experiments.

Treatment with Antisense Compounds

When cells reach appropriate confluency, they were treated with oligonucleotide using a transfection method as described. Other suitable transfection reagents known in the art include, but are not limited to, LIPOFECTAMINE™, OLIGOFECTAMINE™, and FUGENE™. Other suitable transfection methods known in the art include, but are not limited to, electroporation.

Lipofectin™

When cells reached 65-75% confluency, they were treated with oligonucleotide. Oligonucleotide was mixed with LIPOFECTIN™ Invitrogen Life Technologies, Carlsbad, Calif.) in Opti-MEM™-1 reduced serum medium (Invitrogen Life Technologies, Carlsbad, Calif.) to achieve the desired concentration of oligonucleotide and a LIPOFECTIN™ concentration of 2.5 or 3 µg/mL per 100 nM oligonucleotide. This transfection mixture was incubated at room temperature for approximately 0.5 hours. For cells grown in 96-well plates, wells were washed once with 100 µL OPTI-MEM™-1 and then treated with 130 µL of the transfection mixture. Cells grown in 24-well plates or other standard tissue culture plates are treated similarly, using appropriate volumes of medium and oligonucleotide. Cells are treated and data are obtained in duplicate or triplicate. After approximately 4-7 hours of treatment at 37° C., the medium containing the transfection mixture was replaced with fresh culture medium. Cells were harvested 16-24 hours after oligonucleotide treatment.

Cytofectin™

When cells reached 65-75% confluency, they were treated with oligonucleotide. Oligonucleotide was mixed with CYTOFECTIN™ (Gene Therapy Systems, San Diego, Calif.) in OPTI-MEM™-1 reduced serum medium (Invitrogen Life Technologies, Carlsbad, Calif.) to achieve the desired concentration of oligonucleotide and a CYTOFECTIN™ concentration of 2 or 4 µg/mL per 100 nM oligonucleotide. This transfection mixture was incubated at room temperature for approximately 0.5 hours. For cells grown in 96-well plates, wells were washed once with 100 µL OPTI-MEM™-1 and then treated with 130 µL of the transfection mixture. Cells grown in 24-well plates or other standard tissue culture plates are treated similarly, using appropriate volumes of medium and oligonucleotide. Cells are treated and data are obtained in duplicate or triplicate. After approximately 4-7 hours of treatment at 37° C., the medium containing the transfection mixture was replaced with fresh culture medium. Cells were harvested 16-24 hours after oligonucleotide treatment.

Control Oligonucleotides

Control oligonucleotides are used to determine the optimal antisense compound concentration for a particular cell line. Furthermore, when antisense compounds of the invention are tested in antisense compound screening experiments or phenotypic assays, control oligonucleotides are tested in parallel with compounds of the invention.

The concentration of oligonucleotide used varies from cell line to cell line. To determine the optimal oligonucleotide concentration for a particular cell line, the cells are treated with a positive control oligonucleotide at a range of concentrations. The concentration of positive control oligonucleotide that results in 80% inhibition of the target mRNA is then utilized as the screening concentration for new oligonucleotides in subsequent experiments for that cell line. If 80% inhibition is not achieved, the lowest concentration of positive control oligonucleotide that results in 60% inhibition of the target mRNA is then utilized as the oligonucleotide screening concentration in subsequent experiments for that cell line. If 60% inhibition is not achieved, that particular cell line is deemed as unsuitable for oligonucleotide transfection experiments. The control antisense oligonucleotide ISIS 18078 (GTGCGCGCGAGCCCGAAATC, incorporated herein as SEQ ID NO: 19) is a chimeric oligonucleotide, composed of a central "gap" region consisting of 2'-deoxynucleotides, which is flanked on both sides (5' and 3') by "wings". The wings are composed of 2'-O-(2-methoxyethyl) nucleotides, also known as 2'-MOE nucleotides. ISIS 18078 has a 9-nucleotide gap region flanked by 5-nucleotide wing on the 5' side and a 6-nucleotide wing on the 3' side. It is targeted to human Jun N-terminal Kinase-2 and may be used as a positive or negative control in assaying for modulation of expression.

Example 2

Real-Time Quantitative PCR Analysis of ACC1 or ACC2 mRNA Levels

Quantitation of ACC1 or ACC2 mRNA levels was accomplished by real-time quantitative PCR using the ABI PRISM™ 7600, 7700, or 7900 Sequence Detection System (PE-Applied Biosystems, Foster City, Calif.) according to manufacturer's instructions.

Probes and primers for use in real-time PCR were designed to hybridize to target-specific sequences. Methods of primer and probe design are known in the art. Design of primers and probes for use in real-time PCR can be carried out using commercially available software, for example Primer Express®, PE Applied Biosystems, Foster City, Calif.

Prior to quantitative PCR analysis, primer-probe sets specific to the target gene being measured were evaluated for their ability to be "multiplexed" with a GAPDH amplification reaction. After isolation the RNA is subjected to sequential reverse transcriptase (RT) reaction and real-time PCR, both of which are performed in the same well. RT and PCR reagents were obtained from Invitrogen Life Technologies (Carlsbad, Calif.). RT, real-time PCR was carried out in the same by adding 20 µL PCR cocktail (2.5×PCR buffer minus $MgCl_2$, 6.6 mM $MgCl_2$, 375 µM each of dATP, dCTP, dCTP and dGTP, 375 nM each of forward primer and reverse primer, 125 nM of probe, 4 Units RNAse inhibitor, 1.25 Units PLATINUM® Taq, 5 Units MuLV reverse transcriptase, and 2.5×ROX dye) to 96-well plates containing 30 µL total RNA solution (20-200 ng). The RT reaction was carried out by incubation for 30 minutes at 48° C. Following a 10 minute incubation at 95° C. to activate the PLATINUM® Taq, 40 cycles of a two-step PCR protocol were carried out: 95° C. for 15 seconds (denaturation) followed by 60° C. for 1.5 minutes (annealing/extension).

Gene target quantities obtained by RT, real-time PCR were normalized using either the expression level of GAPDH, a gene whose expression is constant, or by quantifying total RNA using RiboGreen™ (Molecular Probes, Inc. Eugene, Oreg.). GAPDH expression was quantified by RT, real-time PCR, by being run simultaneously with the target, multiplexing, or separately. Total RNA was quantified using RiboGreen™ RNA quantification reagent (Molecular Probes, Inc. Eugene, Oreg.).

170 μL of RiboGreen™ working reagent (RiboGreen™ reagent diluted 1:350 in 10 mM Tris-HCl, 1 mM EDTA, pH 7.5) was pipetted into a 96-well plate containing 30 μL, purified cellular RNA. The plate was read in a CytoFluor 4000 (PE Applied Biosystems) with excitation at 485 nm and emission at 530 nm.

GAPDH PCR probes have JOE covalently linked to the 5' end and TAMRA or MGB covalently linked to the 3' end, where JOE is the fluorescent reporter dye and TAMRA or MGB is the quencher dye. In some cell types, primers and probe designed to a GAPDH sequence from a different species are used to measure GAPDH expression. For example, a human GAPDH primer and probe set may be used to measure GAPDH expression in monkey-derived cells and cell lines.

Example 3

Antisense Reduction of Human ACC1 Expression

A series of antisense oligonucleotides was designed to target different regions of human ACC1, using published sequences cited in Table 1. The compounds are shown in Table 2. All compounds in Table 2 are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines. The compounds were analyzed for their effect on gene target mRNA levels by quantitative real-time PCR as described in other examples herein, using the following primer-probe set designed to hybridize to human ACC1:
Forward primer: GGATGGTGTTCACTCGGTAATAGA (incorporated herein as SEQ ID NO: 20)
Reverse primer: GGGTGATATGTGCTGCGTCAT (incorporated herein as SEQ ID NO: 21)
And the PCR probe was:
FAM-CATCAGCAGAGACTACGTCCTCAAGCAAATC-TAMRA (incorporated herein as SEQ ID NO: 22), where FAM is the fluorescent dye and TAMRA is the quencher dye.

A549 cells were treated with 70 nM of the disclosed antisense oligonucleotides using LIPOFECTIN™. A reduction in expression is expressed as percent inhibition in Table 2. If present, "N.D." indicates "not determined". The control antisense oligonucleotide used was SEQ ID NO: 19. The target regions to which these antisense oligonucleotides are inhibitory are herein referred to as "validated target segments."

TABLE 2

Reduction of human ACC1 mRNA levels by chimeric oligonucleotides having 2'-MOE wings and deoxy gap

| ISIS # | Target SEQ ID NO | Target Site | Sequence (5' to 3') | % Inhib | SEQ ID NO |
|---|---|---|---|---|---|
| 366558 | 1 | 848 | ACGAGTATTTCAAAGTCTTA | 46 | 23 |
| 366491 | 2 | 501 | ACCACATCCTCTCATCATTG | 17 | 24 |
| 366492 | 2 | 506 | AGACCACCACATCCTCTCAT | 8 | 25 |
| 366493 | 2 | 542 | CCAGAAAGACCTAGCCCTCA | 5 | 26 |
| 366494 | 2 | 1369 | ATACCTGCAGTTTGAGCCAC | 80 | 27 |
| 366495 | 2 | 1597 | GGGAAGTCATCTGCATTGTT | 10 | 28 |
| 366496 | 2 | 1816 | ATGTGTTCAAATACTGCTGG | 55 | 29 |
| 366497 | 2 | 1821 | GTTCCATGTGTTCAAATACT | 59 | 30 |
| 366498 | 2 | 1970 | GACATCAGCCACCATCTCTG | 57 | 31 |
| 366499 | 2 | 2007 | TCCCCATGGCAATCTGGAGC | 83 | 32 |
| 366500 | 2 | 2053 | GATACCCCATACATCATACG | 28 | 33 |
| 366501 | 2 | 2266 | TCAGCAAATTCATGAAGTCC | 69 | 34 |
| 366502 | 2 | 2271 | GAGAATCAGCAAATTCATGA | 56 | 35 |
| 366503 | 2 | 2362 | TCACCCCGAATAGACAGCTC | 75 | 36 |
| 366504 | 2 | 2367 | GAAAGTCACCCCGAATAGAC | 50 | 37 |
| 366505 | 2 | 2372 | AGTTCGAAAGTCACCCCGAA | 71 | 38 |
| 366506 | 2 | 2593 | GCAGGAAGGACTTGACCCCT | 64 | 39 |
| 366507 | 2 | 2635 | TCATAGATAAGTTCAACATC | 14 | 40 |
| 366508 | 2 | 2830 | GTTTTATTGCCAATTGTGAT | 71 | 41 |
| 366509 | 2 | 2835 | CACAGGTTTTATTGCCAATT | 83 | 42 |
| 366510 | 2 | 3214 | GGAAGGCAGTATCCATTCAT | 60 | 43 |
| 366511 | 2 | 3379 | TACTGAGCCATTTCCTTCTT | 67 | 44 |
| 366512 | 2 | 3384 | TAGCATACTGAGCCATTTCC | 83 | 45 |
| 366513 | 2 | 3575 | CAGATCCATCACCACAGCCT | 67 | 46 |
| 366514 | 2 | 3643 | AGGGCGAATACACATTTGTC | 64 | 47 |
| 366515 | 2 | 3748 | AACTGATCAATAAGCATTGT | 32 | 48 |
| 366516 | 2 | 3908 | CTCTACTTGGTTATGGCGAA | 71 | 49 |
| 366517 | 2 | 3967 | TGCAGGTTCTCAATGCAAAA | 68 | 50 |
| 366518 | 2 | 3972 | GTTTCTGCAGGTTCTCAATG | 73 | 51 |
| 366519 | 2 | 3977 | GATGAGTTTCTGCAGGTTCT | 67 | 52 |
| 366520 | 2 | 4129 | GTGTTGTCCTTAAGCTGGCG | 66 | 53 |
| 366521 | 2 | 4261 | TCGCTGACACTAGCTACATG | 85 | 54 |
| 366522 | 2 | 4492 | TCAGTCTTGATAGCCACATT | 65 | 55 |
| 366523 | 2 | 4662 | GGAATTCTCTATGAAATCTC | 63 | 56 |
| 366524 | 2 | 4699 | TCAAACTTATCCCTTGCTCG | 75 | 57 |
| 366525 | 2 | 4772 | AAAATTTCTCATCCGGTTCA | 55 | 58 |

TABLE 2-continued

Reduction of human ACC1 mRNA levels by chimeric oligonucleotides having 2'-MOE wings and deoxy gap

| ISIS # | Target SEQ ID NO | Target Site | Sequence (5' to 3') | % Inhib | SEQ ID NO |
|---|---|---|---|---|---|
| 366526 | 2 | 4777 | AGGTCAAAATTTCTCATCCG | 71 | 59 |
| 366527 | 2 | 5069 | AATCTTTGATGGGTCCATGA | 53 | 60 |
| 366528 | 2 | 5151 | TGATTTTCAGTTCTGCCTGG | 61 | 61 |
| 366529 | 2 | 5156 | AATGTTGATTTTCAGTTCTG | 53 | 62 |
| 366530 | 2 | 5204 | TGTCAGGAAGAGGCGGATGG | 51 | 63 |
| 366531 | 2 | 5214 | CAGACTCGTTTGTCAGGAAG | 83 | 64 |
| 366532 | 2 | 5317 | ATTCCATGCAGTGGTCCCTG | 84 | 65 |
| 366533 | 2 | 5424 | GCCGAAACATCTCTGGGATA | 71 | 66 |
| 366534 | 2 | 5953 | GTTATCTTGTACCTGGATTC | 73 | 67 |
| 366535 | 2 | 6103 | CGGACAAGGTAAGCCCCAAT | 75 | 68 |
| 366536 | 2 | 6108 | CCAGCCGGACAAGGTAAGCC | 82 | 69 |
| 366537 | 2 | 6133 | TTCTCAACCTGGATGGTTCT | 69 | 70 |
| 366538 | 2 | 6385 | GGAACAAACTCGATGATTCT | 66 | 71 |
| 366539 | 2 | 6390 | TTGTGGGAACAAACTCGATG | 60 | 72 |
| 366540 | 2 | 6440 | GGTTGGGTGAGGACGGCCTG | 42 | 73 |
| 366541 | 2 | 6580 | GTTCGGGTTTCTACAGCAAC | 82 | 74 |
| 366542 | 2 | 7014 | TGGTTTTCACCAGATCCTTT | 76 | 75 |
| 366543 | 2 | 7019 | ACGCATGGTTTTCACCAGAT | 83 | 76 |
| 366544 | 2 | 7175 | GTGCAAGTCAGCAAACTGCA | 54 | 77 |
| 366545 | 2 | 7180 | GTGTCGTGCAAGTCAGCAAA | 61 | 78 |
| 366546 | 2 | 7300 | ATTTTCTTCTTGACCAGGTC | 39 | 79 |
| 366547 | 2 | 7655 | AAGCTCTTCCTACGTGGAAG | 61 | 80 |
| 366548 | 2 | 8964 | CTAGTTGTTGAAAGTAAACT | 47 | 81 |
| 366549 | 2 | 9496 | GATTTGATTTATTGCAAAAA | 21 | 82 |
| 366550 | 2 | 9512 | ACTTGTAGATATGTGGGATT | 27 | 83 |
| 366551 | 2 | 9958 | GTAGAGGTTTATTTCAACAA | 79 | 84 |
| 366552 | 4 | 109 | CCAGAAAGACCTCAGGGTGG | 79 | 85 |
| 366553 | 5 | 252 | CTATAGTCTTTTTGTCTAAT | 24 | 86 |
| 366554 | 5 | 479 | CATGCTGGACCTTTGAAGCA | 5 | 87 |
| 366555 | 6 | 479 | ATTTCAAAGTCTTTGAAGCA | 6 | 88 |
| 366556 | 6 | 592 | GACATGCTGGACCTTGAAAA | 39 | 89 |
| 366557 | 6 | 599 | CAAGCCAGACATGCTGGACC | 73 | 90 |
| 338246 | 6 | 3313 | ACCACAGCCTTCATGTGGCC | 79 | 91 |
| 366482 | 7 | 51352 | CTCACCTCACCTCAGGGTGG | 48 | 92 |
| 366483 | 7 | 109758 | AAATGACCTGGAGCATAGAT | 48 | 93 |
| 366484 | 7 | 111089 | TAACACTTACCTTTGAAGCA | 0 | 94 |
| 366485 | 7 | 120863 | ATTTCAAAGTCTGAGGATAC | 46 | 95 |
| 366486 | 7 | 120974 | GTACCCACACCTTGAAAATC | 37 | 96 |
| 366487 | 7 | 157787 | CTTCAGCATCTGGTAGATAC | 63 | 97 |
| 366488 | 7 | 248329 | CCATGCCAATCTGGAAAGGC | 77 | 98 |
| 366489 | 7 | 275126 | GATGGAACCAGGACCTATGT | 54 | 99 |
| 366490 | 7 | 300424 | GCTCTCTCTGCTTCTGCTAG | 64 | 100 |

Premed oligonucleotides and target regions are those which were sufficiently active to effect at least about a 50% reduction in ACC1. Particularly preferred are oligonucleotides which reduced ACC1 by at least about 70%.

Preferred validated target segments include nucleotides 248329 to 248348 of SEQ ID NO: 7, nucleotides 599 to 618 and 3313-3322 of SEQ ID NO: 6, and nucleotides 109 to 128 of SEQ ID NO: 4. Preferred validated target segments also include nucleotides 1369 to 1388, 2007 to 2026, 2266 to 2285, 2362 to 2381, 2372 to 2391, 2830 to 2849, 2835 to 2854, 3379 to 3398, 3384 to 3403, 3575 to 3594, 3908 to 3927, 3967 to 3986, 3972 to 3991, 3977 to 3996, 4129 to 4148, 4261 to 4280, 4492 to 4511, 4699 to 4718, 4777 to 4796, 5214 to 5233, 5317 to 5336, 5424 to 5443, 5953 to 5972, 6103 to 6122, 6108 to 6127, 6133 to 6152, 6385 to 6404, 6580 to 6599, 7014 to 7033, 7019 to 7038, and 9958 to 9977 of SEQ ID NO: 2.

It is understood that an "active target segment" can be bounded by any two active validated target segments in the tables. A suitable target region is that of nucleotides 5214 to 6152 of SEQ ID NO: 2. The seven oligonucleotides designed within this region all caused a reduction of at least about 70%. Also suitable are target regions defined by the active oligonucleotides falling within the boundaries of the 5214-6152 target region.

Example 4

Antisense Reduction of Human ACC2 Expression

A series of antisense oligonucleotides was designed to target different regions of human ACC2, using published sequences cited in Table 1. The compounds are shown in Table 3. All compounds in Table 3 are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl)nucleotides, also known as 2'-MOE nucleotides. The internucleoside (backbone) linkages are phosphorothioate throughout the oligonucleotide. All cytidine residues are 5-methylcytidines. The compounds were analyzed for their effect on gene target mRNA levels by quantitative real-time PCR as described in other examples herein, using the following primer-probe set designed to hybridize to human ACC2:

Forward primer: CGTGCCCATCAGCATCAC (incorporated herein as SEQ ID NO: 105)
Reverse primer: GAAGGCTACCATGGCTCCC (incorporated herein as SEQ ID NO: 106)
And the PCR probe was:
FAM-CCCTGACCTGCTGAGGCACAGCA-TAMRA (incorporated herein as SEQ ID NO: 107), where FAM is the fluorescent dye and TAMRA is the quencher dye.

A549 cells were treated with 70 nM of the disclosed antisense oligonucleotides using LIPOFECTIN™. "Target site" refers to the 5'-most site on the ACC2 target sequence indicated to which the antisense compound was designed. A reduction in expression is expressed as percent inhibition in Table 3. If present, "N.D." indicates "not determined". The control antisense oligonucleotide used was SEQ ID NO: 19. The target regions to which these antisense oligonucleotides are inhibitory are herein referred to as "validated target segments."

TABLE 3

Reduction of human ACC2 by chimeric oligonucleotides having 2'-MOE wings and a deoxy gap

| ISIS # | Target SEQ ID NO | Target Site | Sequence (5' to 3') | % Inhib of ACC2 mRNA | SEQ ID NO |
|---|---|---|---|---|---|
| 366437 | 9 | 1 | AGACAAAGAAGCAAGACCAT | 0 | 108 |
| 366438 | 9 | 50 | CCAGATTTTTAACCAGGAAA | 10 | 109 |
| 366439 | 9 | 55 | TTCCCCCAGATTTTTAACCA | 21 | 110 |
| 366440 | 9 | 468 | TCATCAGCTGCCTCTTGATG | 20 | 111 |
| 366441 | 9 | 844 | CGGAACATCTCATAGGCCCA | 59 | 112 |
| 366442 | 9 | 1009 | GGGATTCTCTTGGCAATGTC | 0 | 113 |
| 366443 | 9 | 1124 | GGCCCACATGGCCTCACTGG | 46 | 114 |
| 366444 | 9 | 1456 | ATGAGAAAGATGGGCGAGCC | 42 | 115 |
| 366445 | 9 | 1461 | GCTTCATGAGAAAGATGGGC | 47 | 116 |
| 366446 | 9 | 1466 | GGCCAGCTTCATGAGAAAGA | 26 | 117 |
| 366447 | 9 | 1754 | GCAGGGATGTTCCACCTGCA | 26 | 118 |
| 366448 | 9 | 1816 | GGCACGCCCATGGCGATCTG | 43 | 119 |
| 366449 | 9 | 1930 | GCAATGACGTGGCCTCGGGC | 41 | 120 |
| 366450 | 9 | 1958 | GTCTGGGTTTTCGCTGGTGA | 48 | 121 |
| 366451 | 9 | 2036 | GCTGAAGTAACCCCACACGT | 40 | 122 |
| 366452 | 9 | 2041 | GCCACGCTGAAGTAACCCCA | 46 | 123 |
| 366453 | 9 | 2224 | TTCTGGAAGCTCTCGGTCTC | 51 | 124 |
| 366454 | 9 | 2229 | CGTTGTTCTGGAAGCTCTCG | 59 | 125 |
| 366455 | 9 | 2423 | ATCTACGAGGTTCAGTAGTG | 63 | 126 |
| 366456 | 9 | 2474 | CTGCCGGGCCACCTTGAGAA | 46 | 127 |
| 366457 | 9 | 2781 | GGGTCATGATCATCTTCATC | 56 | 128 |
| 366458 | 9 | 2786 | GTTCAGGGTCATGATCATCT | 68 | 129 |
| 366459 | 9 | 2818 | TTGATGTACTTCACCCGGCC | 68 | 130 |
| 366460 | 9 | 3130 | GCCACGCTGGTCATGATCTC | 43 | 131 |
| 366461 | 9 | 3181 | TGGGCCATCACCCTGCGGAC | 53 | 132 |
| 366462 | 9 | 3247 | TCCAGGATGGTGGCTATCTG | 45 | 133 |
| 366463 | 9 | 3252 | GGCAGTCCAGGATGGTGGCT | 49 | 134 |
| 366464 | 9 | 3341 | GCTGCGGTATCTCTGGACCA | 39 | 135 |
| 366465 | 9 | 3421 | GCTTGCTGAAAATGGTGCTC | 56 | 136 |
| 366466 | 9 | 3426 | AGTGGGCTTGCTGAAAATGG | 29 | 137 |
| 366467 | 9 | 3529 | AGCTGGTTCTTCTTGGCCAC | 63 | 138 |
| 366468 | 9 | 3534 | TCACCAGCTGGTTCTTCTTG | 70 | 139 |
| 366469 | 9 | 3565 | TCTGGGCCACACAGCTCATC | 62 | 140 |
| 366470 | 9 | 3754 | AACTGGTGGCCGTACATGTC | 30 | 141 |
| 366471 | 9 | 3759 | GGCAGAACTGGTGGCCGTAC | 54 | 142 |
| 366472 | 9 | 4438 | TCTTCTGCAAACTCATCTCT | 0 | 143 |
| 366473 | 9 | 4481 | CAGCTGGAAGGCCAGGGCAG | 63 | 144 |
| 366474 | 9 | 4534 | TGGTTGGCACAGGGCACGGC | 67 | 145 |
| 366475 | 9 | 4653 | AGGAGGCTTCCTTTGTGATC | 14 | 146 |
| 366476 | 9 | 5083 | AGATCCTTGGTGACGTAGGG | 29 | 147 |
| 366477 | 9 | 5088 | GGAGCAGATCCTTGGTGACG | 48 | 148 |
| 366478 | 9 | 5172 | GTTTAAAGAGAGCCTGCCTG | 57 | 149 |
| 366479 | 9 | 5913 | TGTTGGATGTGTAGACCTCT | 55 | 150 |
| 366480 | 9 | 6933 | CCAGGATGTCAGATATGACG | 34 | 151 |
| 366481 | 9 | 7237 | ACCAGGCCTCGGATGGTCTT | 8 | 152 |
| 366435 | 10 | 87 | CACGGTCATCAGTCAACAAC | 0 | 153 |
| 366436 | 10 | 3680 | GCTCGGAACCAGTAGCCCTG | 30 | 154 |
| 361119 | 12 | 2602 | TCAACCTCTTCCTTCATGTA | 45 | 155 |
| 189530 | 12 | 3579 | AGAAGATGCAGTCCAGCACC | 35 | 156 |
| 189531 | 12 | 3775 | TGCCGCAGCTCGTAGGAGGG | 64 | 157 |
| 189537 | 12 | 3992 | CCGGTGCTGCAGGCTGTTTA | 48 | 158 |
| 189541 | 12 | 5046 | AGAGGCTGATGTCCAGGTAG | 63 | 159 |
| 189542 | 12 | 5242 | AAGAGAGCCTGCCTGAACAT | 23 | 160 |
| 189543 | 12 | 5252 | CCACAGTTTAAAGAGAGCCT | 49 | 161 |
| 189544 | 12 | 5257 | GAGCCCCACAGTTTAAAGAG | 54 | 162 |
| 189545 | 12 | 5338 | CGGTTCATCTCCACCAGCTG | 63 | 163 |
| 189548 | 12 | 5375 | GAAGGCCACCATGCCCACCT | 45 | 164 |
| 189549 | 12 | 5380 | ATTTTGAAGGCCACCATGCC | 16 | 165 |
| 189550 | 12 | 5385 | ACCTCATTTTGAAGGCCACC | 64 | 166 |

TABLE 3-continued

Reduction of human ACC2 by chimeric oligonucleotides having 2'-MOE wings and a deoxy gap

| ISIS # | Target SEQ ID NO | Target Site | Sequence (5' to 3') | % Inhib of ACC2 mRNA | SEQ ID NO |
|---|---|---|---|---|---|
| 189553 | 12 | 5614 | TCTGGGTCCACCCAAGCCAC | 65 | 167 |
| 189557 | 12 | 5963 | CAGGACCTTGTTGAGAGCAC | 37 | 168 |
| 189558 | 12 | 5968 | CTTCCCAGGACCTTGTTGAG | 36 | 169 |
| 189559 | 12 | 5973 | CCTCTCTTCCCAGGACCTTG | 31 | 170 |
| 189560 | 12 | 5980 | GTGTAGACCTCTCTTCCCAG | 49 | 171 |
| 189566 | 12 | 6229 | TTCAGAGTTGGGTGAGGCCT | 26 | 172 |
| 189571 | 12 | 6280 | ATGATTTCCTTGAAACTGCC | 43 | 173 |
| 189572 | 12 | 6285 | GTGCCATGATTTCCTTGAAA | 54 | 174 |
| 189573 | 12 | 6290 | CCAGGGTGCCATGATTTCCT | 52 | 175 |
| 189574 | 12 | 6358 | GTCTCCACAGCAATCACTCC | 25 | 176 |
| 189575 | 12 | 6727 | CTCTCTTTGTCTGCATACAT | 29 | 177 |
| 189576 | 12 | 6732 | CCCTGCTCTCTTTGTCTGCA | 50 | 178 |
| 189589 | 12 | 7301 | GATGGTCTTGAGGACAGAGT | 12 | 179 |
| 366429 | 13 | 27846 | CATGCTCGGCCTGCAGAATA | 14 | 180 |
| 366430 | 13 | 62687 | AGCCACATACCGGGTGGACT | 50 | 181 |
| 366431 | 13 | 80821 | CACTTGGAGAGTCCTCTCTC | 47 | 182 |
| 366432 | 13 | 93058 | TCAGCACAGCAGGCCCCACA | 34 | 183 |
| 366433 | 13 | 121050 | CCCAGGCACCCTACATGAAA | 43 | 184 |
| 366434 | 13 | 125943 | GGCTCAGGGAGGAGAAGGCA | 25 | 185 |

Preferred oligonucleotides and target regions are those which were sufficiently active to effect at least about a 50% reduction in ACC2 expression. Particularly preferred are oligonucleotides which reduced ACC2 by about 60% or greater.

Preferred validated target segments include nucleotides 844 to 863, 2229 to 2248, 2423 to 2442, 2781 to 2800, 2786 to 2805, 2818 to 2837, 3421 to 3440, 3529 to 3548, 3534 to 3553, 3565 to 3584, 4481 to 4500, 4534 to 4553, 5172 to 5191, and 5913 to 5932 of SEQ ID NO: 9. Preferred validated target segments also include 3775 to 3794, 5046 to 5065, 5338 to 5357, 5385 to 5404, 5614 to 5633 of SEQ ID NO: 12.

It is understood that an active target segment can be bounded by any two active validated target segments in the tables. Suitable target segments of SEQ ID NO: 9 include nucleotides 2229 to 2442, nucleotides 2786 to 2837, nucleotides 3529 to 3584 and nucleotides 4481 to 4553. Also suitable is the region of nucleotides 5385 to 5633 of SEQ ID NO: 12.

Example 5

Antisense Reduction of ACC1 and ACC2 Expression: In Vivo Studies in C57BL/6 Mice In a further embodiment of the present invention, antisense compounds were designed to target mouse ACC1 or ACC2, using published sequences, and were screened in vitro in b.END cells or primary mouse hepatocytes using methods described herein. Primer-probe sets used were designed to hybridize to mouse ACC1 or ACC2. The following is a primer-probe set for mouse ACC2:

Forward primer: AGGTGCTCATCGCCAACAA (incorporated herein as SEQ ID NO: 269)

Reverse primer: CCAGCGGCGGATGGA (incorporated herein as SEQ ID NO: 270)

PCR Probe:
FAM-CATCGCTGCGGTCAAGTGTATGCG-TAMRA (incorporated herein as SEQ ID NO: 271), where FAM is the fluorescent dye and TAMRA is the quencher dye.

The following is another primer-probe set for mouse ACC2:

Forward primer: GGGCTCCCTGGATGACAAC (incorporated herein as SEQ ID NO: 272)

Reverse primer: TTCCGGGAGGAGTTCTGGA (incorporated herein as SEQ ID NO: 273)

PCR Probe:
FAM-CTCTGATGAGGACCCTAGTGCCGGC-TAMRA (incorporated herein as SEQ ID NO: 274), where FAM is the fluorescent dye and TAMRA is the quencher dye.

The following is a primer-probe set for mouse ACC1:

Forward primer: CTGGCTGCATCCATTATGTCA (incorporated herein as SEQ ID NO: 275)

Reverse primer: GGGTTGTCCAGTTGCATTTTG (incorporated herein as SEQ ID NO: 276)

PCR Probe:
FAM-CTGGAGCAGCACTTGACCCTGGC-TAMRA (incorporated herein as SEQ ID NO: 277), where FAM is the fluorescent dye and TAMRA is the quencher dye.

Several active compounds were selected for further investigation in mice.

Male C57Bl/6 mice were fed a diet with a fat content of about 4% and were subcutaneously injected with the oligonucleotides shown in Table 4 at a dose of 100 mg/kg once per week for 2 weeks. Shown in Table 4 is the nucleotide sequence of each oligonucleotide, the SEQ ID NO of a nucleic acid which it targets, and the 5'-most target site on the indicated SEQ ID NO to which the oligonucleotide is complementary. The sequences of the oligonucleotides used are shown in Table 4. The antisense oligonucleotides used are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines.

TABLE 4

| Target SEQ ID NO | Target Site | Sequence (5' to 3') | SEQ ID NO |
|---|---|---|---|
| 8 | 5010 | TCCATAGCGCATTACCATGC | 186 |
| 8 | 5150 | TCCTTATACAGGCTGATGTC | 187 |
| 17 | 6170 | TTCCTTGAAACTGCCATGGT | 188 |
| 17 | 223 | GAGTTCCTCTGCTGACTGGC | 189 |
| 8 | 5132 | TCCAAGTAGTAGCCAGACTC | 190 |

TABLE 4-continued

| Target SEQ ID NO | Target Site | Sequence (5' to 3') | SEQ ID NO |
|---|---|---|---|
| 8 | 5648 | CGTGGGATGCCTTCTGCTCT | 191 |
| 12 | 3579 | AGAAGATGCAGTCCAGCACC | 192 |

Saline-injected animals serve as a control. Each treatment group was comprised of five animals. After the treatment period, mice were sacrificed and target levels were evaluated in liver and fat. RNA isolation and target mRNA expression level quantitation are performed using RIBOGREEN™ as described by other examples herein. Results for each treatment group are shown in Table 5 as percent inhibition of target (ACC1 or ACC2) mRNA as compared to saline treated control.

TABLE 5

Reduction of ACC1 or ACC2 in tissues of mice treated with antisense oligonucleotides

| SEQ ID NO | % Inhib of ACC1 | | % Inhib of ACC2 | |
|---|---|---|---|---|
| | Liver | Fat | Liver | Fat |
| 186 | 83 | 91 | 0 | 9 |
| 187 | 61 | 88 | 12 | 46 |
| 188 | 14 | 74 | 42 | 62 |
| 189 | 0 | 59 | 92 | 83 |
| 190 | 63 | 87 | 21 | 57 |
| 191 | 68 | 91 | 28 | 57 |
| 192 | 1 | 75 | 55 | 76 |

As shown in Table 5, oligonucleotides having SEQ ID NO: 186 and 190 caused greater reductions in ACC1 levels than ACC2 levels. Oligonucleotides having the sequence of SEQ ID NO: 189 and 188 caused greater reductions ACC2 levels than ACC1 levels. SEQ ID NO: 190 and 191 caused reductions in both ACC1 and ACC2 levels, while SEQ ID NO: 192 caused similar reductions in ACC1 and ACC2 levels in fat.

The effects of target inhibition on glucose metabolism were evaluated in the mice treated with the antisense compounds of the invention. Plasma glucose was measured at the start of the treatment and after 2 weeks of treatment. Results are shown in Table 6 as the average plasma glucose level for each treatment group. Glucose levels were measured by routine clinical methods, for example using a YSI glucose analyzer (YSI Scientific, Yellow Springs Ohio).

TABLE 6

Effects of ACC1 or ACC2 reduction on plasma glucose levels in C57BL/6 mice

| SEQ ID NO | Plasma glucose (mg/dL) | |
|---|---|---|
| | Week 0 | Week 2 |
| n/a | 196 | 186 |
| 186 | 209 | 192 |
| 187 | 221 | 196 |
| 188 | 215 | 203 |
| 189 | 212 | 188 |
| 190 | 200 | 215 |
| 191 | 213 | 154 |
| 192 | 196 | 158 |

As shown in Table 6, antisense oligonucleotides of the invention reduce plasma glucose levels. Another embodiment of the invention is a method of lowering plasma glucose in an animal by administering an antisense compound of the invention.

Example 6

Effects of Antisense Oligonucleotides Targeted to ACC2: In Vivo Evaluation in Normal Mice A series of antisense oligonucleotides was designed to target different regions of ACC2, using published sequences cited in Table 1. The sequences of the oligonucleotides used are shown in Table 7. All oligonucleotides used in this experiment are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines. The compounds were analyzed for their effect on gene target mRNA levels in C57Bl/6 mice maintained on a standard rodent diet.

C57Bl/6 mice were subcutaneously injected weekly with the oligonucleotides having sequences shown in Table 7 at a dose of 100 mg/kg/week for 3 weeks. Saline injected animals served as the controls. Each treatment group was comprised of five animals. After the treatment period, mice were sacrificed and target levels were evaluated in liver. RNA isolation and target mRNA expression level quantitation are performed as described by other examples herein. Results for each treatment group are shown in Table 7 as a percentage of target (ACC1 or ACC2) mRNA measured from saline treated controls. "Target site" refers to the 5'-most site on the ACC2 target sequence indicated to which the antisense compound was designed. A reduction in expression is expressed as percent inhibition in Table 7.

TABLE 7

Reduction of mouse ACC2 or mouse ACC1 by chimeric oligonucleotides having 2'-MOE wings and deoxy gap-in vivo screen

| Target SEQ ID NO | Target Site | Sequence (5' to 3') | % Inhib of ACC2 mRNA | % Inhib of ACC1 mRNA | SEQ ID NO |
|---|---|---|---|---|---|
| 17 | 223 | GAGTTCCTCTGCTGACTGGC | 55 | 91 | 189 |
| 17 | 1925 | TGGGTTTTCGCTGGTGATCC | 45 | 77 | 193 |
| 17 | 1923 | GGTTTTCGCTGGTGATCCTG | 25 | 70 | 194 |
| 17 | 2091 | TGGCCTCTTCACGGTTCTCG | 25 | 64 | 195 |
| 17 | 2368 | GCAGGGAGGACCTGACCCCT | 27 | 43 | 196 |
| 17 | 2557 | TACGTAGTGTAACTGCTGCC | 5 | 41 | 197 |
| 17 | 2575 | TCAACCTCTTCCTTCATGTA | 35 | 31 | 155 |
| 17 | 3097 | ACACTGGTCATGATCTCCTG | 38 | 54 | 198 |
| 17 | 3277 | TGTGTGTTCATGAAGAAGAC | 35 | 69 | 199 |
| 17 | 3341 | CACCACAGCCTTCATGTAGC | 44 | 26 | 200 |
| 17 | 3921 | GGAACTCCACCACACAGGTG | 0 | 0 | 201 |

TABLE 7-continued

Reduction of mouse ACC2 or mouse ACC1 by chimeric oligonucleotides having 2'-MOE wings and deoxy gap-in vivo screen

| Target SEQ ID NO | Target Site | Sequence (5' to 3') | % Inhib of ACC2 mRNA | % Inhib of ACC1 mRNA | SEQ ID NO |
|---|---|---|---|---|---|
| 18 | 54021 | GGCAGCATGAACTGGAACTC | 7 | 5 | 202 |
| 17 | 4726 | ATGTGGTTGCAGTCAGTGCG | 54 | 61 | 203 |
| 17 | 4738 | AAGTTGAGGAAGATGTGGTT | 7 | 0 | 204 |
| 17 | 4747 | GTGGGCACAAAGTTGAGGAA | 67 | 71 | 205 |
| 17 | 4762 | GGGTCCATGATGACTGTGGG | 0 | 58 | 206 |
| 17 | 4927 | AGGTAGTAGCCAGACTCGTT | 68 | 75 | 207 |
| 17 | 5336 | GATGTCATTGCCGATGACAA | 26 | 0 | 208 |
| 18 | 30804 | GAAGCTGCCATCCTGGCTGT | 70 | 3 | 209 |
| 17 | 1932 | CCTCATCTGGGTTTTCGCTG | 84 | 88 | 210 |
| 17 | 2071 | CCCCAGGAGAAGCAGTGCCC | 80 | 42 | 211 |

As shown in Table 7, antisense oligonucleotides targeted to ACC1 or ACC2 can reduce expression of ACC1, ACC2, or both ACC1 and ACC2. To assess the physiological effects resulting from inhibition of target mRNA, the mice were further evaluated at the end of the treatment period for plasma triglycerides, plasma cholesterol, and plasma transaminase levels. Triglycerides (TRIG) and cholesterol (CHOL) were measured at the beginning of the experiment (Wk 0) and at study termination (Wk 3) by routine clinical analyzer instruments (e.g. Olympus Clinical Analyzer, Melville, N.Y.). Glucose levels were measured using a glucose analyzer, for example, a YSI glucose analyzer (YSI Scientific, Yellow Springs, Ohio). Average plasma glucose levels for each treatment group are presented in Table 8 in mg/dL. Resulting measurements are presented in Table 8 as the average level per treatment group. Cholesterol and triglyceride levels are shown in mg/dL.

TABLE 8

Effect of antisense oligonucleotides targeted to ACC2 on plasma triglycerides, cholesterol

| SEQ ID NO | Plasma glucose | | Triglycerides | | Cholesterol | |
|---|---|---|---|---|---|---|
| | Wk 0 | Wk 3 | Wk 0 | Wk 3 | Wk 0 | Wk 3 |
| n/a | 177 | 176 | 118 | 79 | 89 | 75 |
| 193 | 194 | 184 | 113 | 113 | 92 | 95 |
| 194 | 186 | 172 | 129 | 127 | 90 | 89 |
| 195 | 185 | 176 | 119 | 124 | 97 | 90 |
| 196 | 189 | 191 | 114 | 155 | 87 | 99 |
| 197 | 198 | 173 | 90 | 174 | 94 | 89 |
| 155 | 164 | 176 | 100 | 106 | 97 | 95 |
| 198 | 171 | 183 | 108 | 116 | 104 | 88 |
| 199 | 179 | 179 | 143 | 85 | 102 | 108 |
| 200 | 170 | 181 | 123 | 118 | 98 | 94 |
| 201 | 192 | 183 | 129 | 121 | 90 | 95 |
| 202 | 185 | 172 | 97 | 100 | 87 | 67 |
| 203 | 215 | 174 | 123 | 137 | 91 | 232 |
| 204 | 195 | 177 | 140 | 115 | 93 | 95 |
| 205 | 204 | 166 | 106 | 146 | 94 | 105 |
| 206 | 207 | 165 | 180 | 132 | 101 | 100 |
| 207 | 197 | 179 | 135 | 119 | 101 | 76 |
| 208 | 189 | 155 | 81 | 102 | 102 | 92 |
| 209 | 202 | 167 | 86 | 118 | 98 | 86 |
| 210 | 213 | 159 | 121 | 142 | 95 | 81 |
| 211 | 176 | 159 | 101 | 126 | 88 | 100 |
| 189 | 200 | 159 | 103 | 85 | 80 | 86 |

Body weight was monitored throughout the study. Increases in body weight through the course of the study were comparable for animals receiving antisense oligonucleotides and saline-treated control animals. Also monitored upon termination of the study were spleen, liver, and adipose tissue weights. For saline-treated control animals, liver, adipose, and spleen weights averaged about 1 g, about 0.3 g, and about 0.2 g, respectively. For animals treated with antisense oligonucleotides targeted to ACC2, liver, fat, and spleen weights ranged from about 1 to 3 g, about 0.1 to 0.4 g, and about 0.1 to 0.2 g, respectively.

Example 7

Effects of Antisense Inhibition of ACC1 and ACC2 Expression: In Vivo Studies in a Mouse Model of Diet-Induced Obesity Male C57BL/6 mice received a 60% fat diet for 12 weeks, after which mice were subcutaneously injected weekly with the oligonucleotides described in Table 9 at a dose of 50 mg/kg/week for 6 weeks. High-fat fed saline-injected or animals injected with the scrambled control oligonucleotide ISIS 141923 (CCTTCCCTGAAGGTTCCTCC, incorporated herein as SEQ ID NO: 212) served as controls. As another control, animals fed normal chow were likewise injected with saline. ISIS 141923 and the oligonucleotides of shown in Table 9 are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines.

TABLE 9

| Target SEQ ID NO | Target Site | Sequence (5' to 3') | SEQ ID NO |
|---|---|---|---|
| 8 | 5010 | TCCATAGCGCATTACCATGC | 186 |
| 17 | 1925 | TGGGTTTTCGCTGGTGATCC | 193 |
| 17 | 3277 | TGTGTGTTCATGAAGAAGAC | 199 |
| 17 | 4762 | GGGTCCATGATGACTGTGGG | 206 |
| 17 | 1932 | CCTCATCTGGGTTTTCGCTG | 210 |
| 17 | 4927 | AGGTAGTAGCCAGACTCGTT | 207 |

Each treatment group was comprised of seven a animals. After the treatment period, mice were sacrificed and target levels were evaluated in liver. RNA isolation and target mRNA expression level quantitation are performed as described by other examples herein. Results for each treatment group are shown in Table 10 as a percentage of control (target ACC1 or ACC2 mRNA measured from saline treated high-fat fed controls).

TABLE 10

Reduction of ACC1 or ACC2 expression in high-fat fed mice treated with antisense oligonucleotides targeted to ACC1 or ACC2

| SEQ ID NO | ACC1 | ACC2 |
|---|---|---|
| | % Control | |
| 186 | 12 | 70 |
| 210 | 26 | 11 |
| 193 | 64 | 35 |
| 212 | 79 | 64 |
| Saline, normal chow | 87 | 114 |
| 199 | 46 | 9 |
| 206 | 68 | 42 |
| 207 | 31 | 43 |

As shown in Table 10, antisense oligonucleotides targeted to ACC1 or ACC2 reduce target expression levels in vivo.

Body weight and food consumption were monitored throughout the study. Cumulative food consumption for each treatment group was similar to that of saline-treated high-fat fed mice. Average body weights measured for each treatment group at the beginning (Wk 0) and at the end (Wk 6) of the study are presented in Table 11.

TABLE 11

Body weight of animals treated with antisense oligonucleotides

| | Body weight (g) | |
|---|---|---|
| SEQ ID NO | Wk 0 | Wk 6 |
| Saline, high fat fed | 41 | 45 |
| 186 | 42 | 39 |
| 210 | 42 | 43 |
| 193 | 43 | 41 |
| 212 | 42 | 42 |
| Saline, normal chow | 27 | 28 |
| 199 | 37 | 37 |
| 206 | 38 | 36 |
| 207 | 38 | 37 |

Also measured upon termination of the study were spleen, liver, and epididymal fat pad weights. Fat pad weights were reduced in the animals treated with antisense compounds targeting ACC1 or ACC2 as compared to high-fat fed animals treated with saline or animals treated with the control oligonucleotide ISIS 141923. These results, taken together, show that antisense inhibition of ACC1 or both ACC1 and ACC2 cause reductions in fat pad weight without altering body weight or food consumption in an animal model of diet-induced obesity. Therefore, other embodiments of the invention include methods of reducing adiposity, methods of treating obesity, and methods of treating diet-induced obesity in an animal by administering an antisense compound of the invention.

To assess the physiological effects resulting from inhibition of target mRNA, the diet-induced obese mice that receive treatment were further evaluated at the beginning of the study (Wk 0), during the third week of treatment (Wk 3), and during week 5 of treatment (Wk 5) for plasma triglycerides, plasma cholesterol, and plasma HDL and LDL. Plasma triglycerides and cholesterol were measured by routine clinical analyzer instruments (e.g. Olympus Clinical Analyzer, Melville, N.Y.). Average plasma triglycerides (TRIG), cholesterol (CHOL), LDL and HDL levels for each treatment group are presented in Table 12 in mg/dL.

TABLE 12

Effects of antisense oligonucleotides on plasma lipid levels in mice fed a high-fat diet

| Treatment SEQ ID | TRIG | | | CHOL | | | HDL | | | LDL | | |
|---|---|---|---|---|---|---|---|---|---|---|---|---|
| NO | Wk 0 | Wk 2 | Wk 5 | Wk 0 | Wk 2 | Wk 5 | Wk 0 | Wk 2 | Wk 5 | Wk 0 | Wk 2 | Wk 5 |
| Saline, high fat fed | 99 | 93 | 86 | 185 | 182 | 181 | 148 | 146 | 152 | 20 | 23 | 26 |
| 186 | 94 | 101 | 80 | 184 | 162 | 65 | 150 | 130 | 51 | 19 | 18 | 11 |
| 210 | 112 | 128 | 99 | 198 | 170 | 160 | 157 | 130 | 126 | 21 | 26 | 26 |
| 193 | 107 | 101 | 83 | 184 | 179 | 178 | 144 | 142 | 146 | 19 | 21 | 24 |
| 212 | 124 | 83 | 99 | 196 | 192 | 193 | 157 | 158 | 167 | 21 | 21 | 20 |
| Saline, normal chow | 175 | 125 | 112 | 103 | 90 | 98 | 76 | 71 | 78 | 12 | 11 | 11 |
| 199 | 80 | 59 | 73 | 144 | 149 | 191 | 116 | 122 | 151 | 15 | 20 | 29 |
| 206 | 77 | 65 | 68 | 121 | 134 | 129 | 97 | 106 | 101 | 13 | 19 | 23 |
| 207 | 89 | 87 | 76 | 148 | 152 | 136 | 119 | 123 | 113 | 17 | 17 | 15 |

As shown in Table 12, oligonucleotides having the sequences of SEQ ID NO: 186 and 210 caused decreases in plasma cholesterol levels over the course of the study. Therefore, another embodiment of the present invention is a method of lowering cholesterol levels in an animal by administering an antisense compound of the invention. Treatment with the antisense oligonucleotide having SEQ ID NO: 186 also resulted in decreased LDL levels over the course of the study. Therefore, another embodiment of the present invention is a method of lowering LDL levels in an animal by administering an antisense compound of the invention.

Tissue triglyceride levels were measured using a Triglyceride GPO Assay from Roche Diagnostics (Indianapolis, Ind.). Liver triglyceride levels are used to assess hepatic steatosis, or accumulation of lipids in liver. When normalized to liver triglyceride levels measured for saline treated high-fat fed control animals, treatment with the control ISIS 141923 reduced liver triglycerides by 35%, and saline-treated mice fed normal chow had 82% lower liver triglycerides than the high-fat fed counterparts. High-fat fed animals treated with oligonucleotides having SEQ ID NO: 186, 210, or 193 showed decreases of 67%, 70%, and 46%, respectively. Treatment with SEQ ID NO: 199, 206, or 207 caused reductions of 44%, 46%, or 71%, respectively. Therefore, treatment with antisense oligonucleotides which reduce ACC1 and ACC2 decreases liver triglyceride content. Other embodiments of the invention include a method of lowering liver triglycerides and a method of ameliorating hepatic steatosis in an animal by administering an antisense compound of the invention.

The effects of target inhibition on glucose and insulin metabolism were also evaluated in the diet-induced obese mice treated with the antisense compounds of the invention. Plasma glucose was measured at the start of treatment and after 2 weeks and 5 weeks of treatment. Plasma insulin was similarly measured at the beginning of the treatment, and following 2 weeks and 5 weeks of treatment.

Glucose tolerance tests were also administered. Mice received intraperitoneal injections of 1 g/kg dextrose, and the blood glucose levels were measured before the glucose challenge and at 30 minute intervals for 2 hours. Glucose levels were measured using a glucose analyzer, for example a YSI glucose analyzer (YSI Scientific, Yellow Springs, Ohio) and insulin levels were measured using an Alpco insulin-specific ELISA kit from (Windham, N.H.). Changes in glucose metabolism were assayed by plotting the blood glucose levels at each time point and comparing the area under the curves created. No substantial alterations in the area under the curve were observed for the treatment groups as compared to control, thus glucose tolerance was neither improved nor worsened by treatment with antisense oligonucleotides targeted to ACC1 or ACC2. No substantial alterations were observed in fed or fasted blood glucose levels for animals treated with the antisense oligonucleotides. Fed insulin levels increased in saline-treated control high-fat fed mice from about 4 to 6 ng/mL over the course of the study. In contrast, treatment with antisense oligonucleotides having sequences of SEQ ID NO: 186, 210, or 193 caused decreases in insulin levels from about 4 to 3 ng/mL over the course of the study. Treatment with the oligonucleotides having SEQ ID NO: 199 or 207 likewise caused decreases in insulin levels from about 3 ng/mL to about 1 ng/mL. Treatment with the oligonucleotide having the sequence of SEQ ID NO: 206 caused a decrease from about 5 ng/mL to about 1 ng/mL. Therefore, another embodiment of the present invention is a method of improving insulin sensitivity, measured as a reduction in plasma insulin levels, in an animal by administering an antisense compound of the invention.

Body composition was assayed at the beginning of the study (Wk 0), during week 3 of treatment (Wk 3), and at the end of the treatment period (Wk 6) by DEXA scan measurement of fat mass and lean mass. Results are shown in Table 13 as average percentage body fat for each treatment group.

TABLE 13

| Body composition of mice fed a high fat diet | | | |
|---|---|---|---|
| Treatment | % Body Fat | | |
| SEQ ID NO | Wk 0 | Wk 3 | Wk 6 |
| Saline, high fat fed | 39 | 42 | 42 |
| 186 | 39 | 38 | 29 |
| 210 | 39 | 38 | 35 |
| 193 | 39 | 38 | 33 |
| 212 | 40 | 39 | 37 |
| Saline, normal chow | 17 | 15 | 15 |
| 199 | 32 | 32 | 28 |
| 206 | 32 | 28 | 22 |
| 207 | 32 | 31 | 28 |

As shown in Table 13, oligonucleotides targeted to ACC1 or ACC2 reduce body weight in high-fat fed animals. Another embodiment of the present invention is a method of reducing adiposity or body fat in an animal by administering an antisense compound of the invention.

Example 8

Effects of Antisense Reduction of ACC1 and ACC2 Expression: In Vivo Studies in Ob/Ob Mice Leptin is a hormone produced by fat that regulates appetite. Deficiencies in this hormone in both humans and non-human animals leads to obesity. ob/ob mice have a mutation in the leptin gene which results in obesity and hyperglycemia. As such, these mice are a useful model for the investigation of obesity and diabetes and treatments designed to treat these conditions. In accordance with the present invention, the antisense compounds of the invention are tested in the ob/ob model of obesity and diabetes.

Male C57Bl/6J-Lep ob/ob mice (Jackson Laboratory, Bar Harbor, Me.) were subcutaneously injected weekly with the antisense oligonucleotides having the sequences indicated in Table 14 at a dose of 50 mg/kg/week for 6 weeks. The oligonucleotides used are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines.

Saline-injected animals served as controls. Each treatment group was comprised of six animals.

TABLE 14

| Target SEQ ID NO | Target Site | Sequence (5' to 3') | SEQ ID NO |
|---|---|---|---|
| 8 | 5010 | TCCATAGCGCATTACCATGC | 186 |
| 17 | 1925 | TGGGTTTTCGCTGGTGATCC | 193 |
| 17 | 1932 | CCTCATCTGGGTTTTCGCTG | 210 |
| 17 | 4927 | AGGTAGTAGCCAGACTCGTT | 207 |

After the treatment period, mice were sacrificed and target levels were evaluated in liver. RNA isolation and target mRNA expression level quantitation are performed as described by other examples herein. Results for each treatment group are shown in Table 15 as a percentage of saline-treated controls.

TABLE 15

| Inhibition of ACC1 or ACC2 expression in ob/ob mice treated with antisense oligonucleotides targeted to ACC1 or ACC2 | | |
|---|---|---|
| SEQ ID NO | % Inhib of ACC1 | % Inhib of ACC2 |
| 186 | 92 | 12 |
| 210 | 79 | 80 |
| 193 | 52 | 63 |
| 207 | 83 | 76 |

Liver triglyceride levels, measured as described herein, were lower than that of salme-treated control animals for all treatment groups. Treatment with the oligonucleotide having the nucleobase sequence of SEQ ID NO: 186 reduced plasma cholesterol and LDL levels as compared to saline-treated controls. Therefore, these effects of the antisense compounds of the invention occur independent of leptin signaling. Embodiments of the current invention include methods of lowering liver triglycerides in an animal by administering an antisense compound of the invention, methods of improving hepatic steatosis in an animal by administering an antisense compound of the invention, and methods of lowering plasma cholesterol or LDL levels in an animal by administering an antisense compound of the invention.

Example 9

Chimeric Oligonucleotides Having 2'-MOE Wings and Deoxy Gap Designed to Human ACC1

A series of antisense oligonucleotides was designed to target different regions of human ACC1, using published sequences cited in Table 1. The oligonucleotides are shown in Table 16. All compounds in Table 16 are chimeric oligonucleotides ("gapmers") 20 nucleotides in length, composed of a central "gap" region consisting of 10 2'-deoxynucleotides, which is flanked on both sides (5' and 3') by five-nucleotide "wings". The wings are composed of 2'-O-(2-methoxyethyl) nucleotides, also known as 2'-MOE nucleotides. The internucleoside (backbone) linkages are phosphorothioate throughout the oligonucleotide. All cytidine residues are 5-methylcytidines.

TABLE 16

Chimeric oligonucleotides having 2'-MOE wings and deoxy gap designed to human ACC1

| ISIS # | Target SEQ ID NO | Target Site | Sequence (5' to 3') | SEQ ID NO |
|---|---|---|---|---|
| 381739 | 2 | 655 | GAGTGCTGGTTCAGCTCCAG | 213 |
| 381740 | 2 | 889 | TCTATTTTCTTTCTGTCTCG | 214 |
| 381741 | 2 | 910 | ACAGTGAAATCTCGTTGAGA | 215 |
| 381742 | 2 | 958 | ATCACTTTATTTCCCCCAAA | 216 |
| 381743 | 2 | 1006 | ATGCATTTCACTGCTGCAAT | 217 |
| 381744 | 2 | 1102 | GCATTGGCTTTAAGGTCTTC | 218 |
| 381745 | 2 | 1234 | CCCCAGCCAGCCCACACTGC | 219 |
| 381746 | 2 | 1549 | CCCTCTGAGGCCTTGATCAT | 220 |
| 381747 | 2 | 1621 | GCTTGAACCTGTCTGAAGAG | 221 |
| 381748 | 2 | 1963 | GCCACCATCTCTGTACAAGG | 222 |
| 381749 | 2 | 1996 | ATCTGGAGCTGTGCTGCAGG | 223 |
| 381750 | 2 | 2242 | GCAGCAGCAACACTGAAATA | 224 |
| 381751 | 2 | 2357 | CCGAATAGACAGCTCCTTCA | 225 |
| 381752 | 2 | 2377 | ACTGTAGTTCGAAAGTCACC | 226 |
| 381753 | 2 | 2452 | AGTCTGTCCAGCCAGCCAGT | 227 |
| 381754 | 2 | 2567 | GGAGTGAAGGAAGTTAGAGA | 228 |
| 381755 | 2 | 2629 | ATAAGTTCAACATCTACTGT | 229 |
| 381756 | 2 | 2665 | CGAGTCACCTTAAGTACATA | 230 |
| 381757 | 2 | 2840 | AAACACACAGGTTTTATTGC | 231 |
| 381758 | 2 | 2845 | TTCTCAAACACACAGGTTTT | 232 |
| 381759 | 2 | 2850 | TTTCCTTCTCAAACACACAG | 233 |
| 381760 | 2 | 2855 | GTCATTTTCCTTCTCAAACA | 234 |
| 381761 | 2 | 2896 | TGGATTAACTTCCCAGCAGA | 235 |
| 381762 | 2 | 2965 | ATCTTCATTACCTCAATCTC | 236 |
| 381763 | 2 | 3389 | GTTGCTAGCATACTGAGCCA | 237 |
| 381764 | 2 | 3394 | GTGATGTTGCTAGCATACTG | 238 |
| 381765 | 2 | 3424 | TGCTGGCTGGGAAACTGACA | 239 |
| 381766 | 2 | 3541 | ATGCCACTTCGGTACCTCTG | 240 |
| 381767 | 2 | 4165 | GATGTGGGCAGCATGAACTG | 241 |
| 381768 | 2 | 4186 | ATGTTCCCTCTGTTTGGATG | 242 |
| 381769 | 2 | 4516 | AGCCTGTCATCCTCAATATC | 243 |
| 381770 | 2 | 4615 | CTGAAATCCTTTTGTGCAAC | 244 |
| 381771 | 2 | 4693 | TTATCCCTTGCTCGGAATGT | 245 |
| 381772 | 2 | 4741 | AAAGCCAGAGCAGGCTCCAG | 246 |
| 381773 | 2 | 4813 | AGGTGCATCTTGTGATTAGC | 247 |
| 381774 | 2 | 4876 | CGAACAAAGAACCTGTAGTC | 248 |
| 381775 | 2 | 5068 | ATCTTTGATGGGTCCATGAT | 249 |
| 381776 | 2 | 5098 | CGCATTACCATGCTCCGCAC | 250 |
| 381777 | 2 | 5146 | TTCAGTTCTGCCTGGAGGAC | 251 |
| 381778 | 2 | 5200 | AGGAAGAGGCGGATGGGAAT | 252 |
| 381779 | 2 | 5265 | CTGTCCTGGAGTCAGTCACT | 253 |
| 381780 | 2 | 5270 | CTGTGCTGTCCTGGAGTCAG | 254 |
| 381781 | 2 | 5275 | ATGATCTGTGCTGTCCTGGA | 255 |
| 381782 | 2 | 5280 | GAAACATGATCTGTGCTGTC | 256 |
| 381783 | 2 | 5416 | ATCTCTGGGATATCATATAT | 257 |
| 381784 | 2 | 6019 | CCAGCAATCATTCCAGAACC | 258 |
| 381785 | 2 | 6439 | GTTGGGTGAGGACGGCCTGC | 259 |
| 381786 | 2 | 6631 | TTGGCTTCAGAATCCAGGTT | 260 |
| 381787 | 2 | 6636 | TTATCTTGGCTTCAGAATCC | 261 |
| 381788 | 2 | 6646 | GCCTGCTGGATTATCTTGGC | 262 |
| 381789 | 2 | 6745 | CTCCAGTTGGCAAAGACCAT | 263 |
| 381790 | 2 | 6982 | ATTTCTACTGTCCCTTCTGG | 264 |
| 381791 | 2 | 7122 | CCTCCCGCTCCTTCAACTTG | 265 |
| 381792 | 2 | 7144 | TGGTAAATGGGAATTAGGAA | 266 |
| 381793 | 2 | 7174 | TGCAAGTCAGCAAACTGCAC | 267 |
| 381794 | 2 | 7201 | TTCTCCTGCATCCGGCCTGG | 268 |

The oligonucleotides in Table 16 may be analyzed for their effect on gene target mRNA levels by quantitative real-time PCR as described in other examples herein, using a primer-probe set designed to hybridize to human ACC1. ISIS 381779, ISIS 381780, ISIS 381781, ISIS 381782, ISIS 381783, and ISIS 381784 fall within the suitable target region of nucleotides 5214 to 6152 of SEQ ID NO: 2.

SEQUENCE LISTING (277 sequences)

SEQ ID NO: 1 - DNA, 10128 bp, H. sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaa

SEQ ID NO: 2 - DNA, 10018 bp, H. sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaaa

SEQ ID NO: 3 - skipped

SEQ ID NO: 4 - DNA, 9585 bp, H. sapiens
cggcctggtgctgcacgcctgtcagccatcgcccgagccgccggcgtctcctcccgcccagcagttcctccacgcaggggctccggaatcgcccgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaaa

SEQ ID NO: 5 - DNA, 9655 bp, H. sapiens
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaaa

SEQ ID NO: 6 - DNA, 9766 bp, H. sapiens
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaaa

SEQ ID NO: 7 - DNA, 325776 bp, H. sapiens
cggggcactggggcaccgcccagacgcggggcgggcccccggggtcaggcccggccccacaccgccctcccccacagagcggcgaggcccgccgctgcccgcccgccggcccgccagcctgccgcgtcaagcccgccgccggggcccgcagcccgcgactcctcccccgccgcacctcgtggcccccgcttctccctagtcccgctagaggggctcgcgctccgccacccgcccgcccgcccagcgctgcctggcgcctcacctcgccgagaccccctaatccgcgccaaagagccgccggtcgcgcgcgcctccgggctttgcgtgcgcgcccccgggcggcgcagtggcgagcgcgccgcgtgccgcgcgcccgccgcctccgcccctcggccgtggaggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtatgtcccaagatctcttattactgctgttaatgatgattctaatagctaccatttgtcgagtacttattgcatgccagacattgcacaaagcaggttacacatacggtctcatttaaaacttgtgaggtaggcacctgttgttatccctattttccaggtgaagaaatctaggcactgacataaataacttgggatcacactgctaggaagtactggggaagggaattcaaaccatggtttatctgaactatataactgttacatctatttagaagtctgcctttgataaatttgcccaacctttttttagaattcacttacactttatacctgtgtgaaccctttcattcttttttggtatatgcataatacaagttcattccaaaaaaaaaaaaaaaaaaaagccctgccgggcgcggtggctcacgcctgtaattccagcactttggcaggccgaggcgggcggatcacagggtctggagttctagaccagcctgaccaacatggtgaaatcccgtctctactaaaaatacaaaaaattacgcgggtgtggtggcaggcacctgtaatcccagctactccggaggctgaggcagtagaatcgcttgaaccctgggggcagaggttacaatgagccaagatcttgccattccactccagcctgggcaacgagagcgaaactctgtctcaaaaagaaaagaaaaggaaagaaaaaccacctcccaccaggttaaataaataattaacattttggtatgtacccttccagacattttcctatgcatcacatcaataaatatatgataggatattttacatttgatgtatcctgaagattaattcaacaaatgtttagtgagtaggcttgttgtaggtgctgggaattcagcagtgaacaaaacaaagtctctgcctcatggagctcatattatagtagggaagactgtcaataagcaatatacacattactaaatgatagataatgcccagtaatgtggcaagttttatggaaaaataaatcaggataaaaggataagagtgatatggggattctcttagttagggtagataaggaaggcctcttagctaaggaggcacataaatatctgatcatttaatgagagaaggagcaacatggatttctagagggaaactatcctagaagagaagcagcaagtgcagtgaccctgaaatggggatttgtttggcatggagaaagggcaagaccagtgtggctggagcacagcaaatgagagaaattagatggaaatcaaggcagatcatgtatcatctggtaaggtttggattttattgggaagtgacagaatatgacgaagggttgagagcaaaggagtagctttgctgtaaaaggatcactgtgggctgggagcggtggctcacacctgtaatcccatcactttgggaggccgaggcaggcggatcacttgaggttagaagttcgagaccagcctggtcaacatggtgaaacctcatctctactaaaaatacaaaaaaaattagctgggcattgtgacgggcgcctgtaatcccagctactcgggaggctgaggtaggagaatcacttgaacctgggaggtggaggttgcagtgagccaagattgtgccactacactcaagcctgggcaacagagtgaaactgcatctcaaaaaaaaaaaaaaaaaaaaaaaatcactgtggcagctgtgtggagaatggatggtagaaatattaaaattgccctttgcctggtgaagtggtgtgtacctgtaatcccagctactcgagagactgaggcaggaggatggattgagcccaagtttgagaccagtctaggcaacgtatcgagacccccatctctaaaaaaattttaaattgctctctaaggcataaattgtccttttacatggtagttgttcaacagatagttgattaacattagtgtttcacctatagctgtacagctttacaaccactctcaacttcacatagtggaagtggggtcagtcatttaggacatatctgtgtctttgtcattgaaactcaaattttgagactggctaaggcaaatatccagatctggatgtcatgattgtcaacaatgaatatcagtaatcagtgttgtaatactgtagaaaaattagtcccacataatactgagatctagtcgttaaaaacatagcattcaggggccaggcacagtggctcattcctgtaatcccagcagtttgggaggccaaggcagatggatcatttgaggccagtagttcaagatcagcctgggcaacatggcgaaaacccatctctgctaaaaatgcaacaattagctgggtgtggtggcgcatgcctgtaatcccagcttcttgggaggcgcaagaattgcttgaaccctggaggtggaggttgcagtgagctgaaatcgcaccactgccctccagcctgttcaacagagcaagagtctgtctcaaaaacaaaaaaacaaaaatcatagcattcaactacctggaaattaccctctcccttcagttgatgttaggctctacttagaccaatttagtcagtgtgcttaagaaagatgtggagagggcaggacacggtgcctcacacctgggatccctgcattttgggaagccaaggtaggcagatcacttgagttcaggagttcaaggaggcatgagaactgggcaacatggtgaaacttcgtctctacaaaaattgcaaaaattagccaggtgtagtggcgcatgcctgtagtcccagctacttaggaggctgaggtgagaggatcacttcagcccagagggttgaggctgcattgacccagtatcacaccactgcactccagcctaggtgacagagtgagacactgtaccaaaaaaaaaaaaaaaaaaaagatgtggcaaaattaacatgcacagtgagaagaagggtaacactgattactgattaaggcagtactcctctgggtttttgtcttaagtggatgtgatagtggcatcacttacacgaccagctgaaggaagaatagatttggaggagaaattgaaagttctgttttggatctgtgttttgcattctgactggaaatgacaaatacaagtctacagctcattggaggtgtcagaactaaaactgtataactgtattagaattgtttatttggctgtgtgtcttacctagacagaccttgaggacagacactgttgtctttgtaacctcagtgctctgaagtgtatcctcaaatacttgtgaaatgagtaagtaaaggcaaaagtaaaaatgaagtcactggctgggtgcagtggctcacgcctgtaatcccagcactttgggaggctgaggcgggcggatcacgaggtcaggagatcgagaccatcctggctaacatggtgaaaccccatctcaactaaaaatacaaaaaattagccgggcgtggtggtgggcgcctgtagtcccagctactcaggaggctgaggaagaagaatggcgtgaacctgggaggtggagcttgcagtgagctgagatcgtgccgctgtactccagcctgggcaacagagcgagactctgtctcaaaaaaaaaaagaatgaagtcacttaggcaaaatgtagaagatacatactctatgctttcactgaaagtctaagcacctgaatgtgacttacaagtagggtgaccataatttctgatttgctgagaatagcctggtttatatctgttgtccctacctaagtattaatattgcctggtttcactctcagtaaagtctccatttgtacaataaatttatattgtcattctttttagaaggcccttccagatctagcatcttcctgtatctttatcatcactgccctatcttagactccatttgccagccaggtggacataccttcatttctcatatgcactcttaacttcaaggttttttttgccaaggtactgcctacctcacttagacatcacttccttaggaacacttctcctgaccccccaatggctgagttaagtcaccctcttacatgttcccagtacaccttgtatttaacctgtcatagcaaagatgactaagtgccttgttccctcactaaatatctctgtaaaggaacccaaaaaaacaccttttgtcctctttaagccataaatttatattaataatatccaaatccatgttgaaccagtatttttgaagattgaccttcaggataaactaatagcacaatcttcatgccctttcattcataactaactgaaaaggttgacttttgtaccaggaacccaacgaagaaaacttgtatcttgtcagggttggtaacctggctgccattgactgagaccaaaatatcccaacagtttgtcctcagctgctaagctgctgtggttagaatcaaacgtagagtttctggcctggtgcggtggctcatgcctgtaatcccaacactttgacagtcctaggtgggaagattgcttgggctcaggagttcgagactaaactgggtgacttagtgagagttcaactctacaaaaaaatcaaaaaattagctgggcatgatagcacacgcctgtggtcccagctacttgggaggctgaggtaggagaatcacttgagctcagacagttgaggctgtagtgaccgtgattgtgccactttactccagcctgggcaacagagtgagacctcgtctggaaaaaaaaaaaaaaggtaaagagacaacctacggaatgggagaaaatattcacgacccctacatcagataagtggacaagggcctgaaaagacattgctcaaaagaagacatgcaagtagcatgggaggccgaggcgggtggatcacctgaggtcaggagttcaagaccagccgggccaacctggtgaaaccctgtctctactaaaaaaacaaaaattagctgggcgtggtggcgggcgcttgtattcccagctactcaggaggctgaggcaggagaatcacttgaacccaggaggcggaggttgcagtgagccaagatcacaccattgccctccagcctgggcaacagcaagactctgtctcaaaaaaaaaaaaaaaagaaaaacaaaagaaaaagacatgcaaatagctaactggtatgtgaaaaaaatgttcaacatcactaatcatcagggaaatgtgaattaaaactaccatgagatatcacctcacacctgtcagaatgattattatcaaaaagcgagataagcattggcaaggatgtggagaaaaaccctgtacactgtcagtgggaatgtaaattagtacagccattttggaaaatagtatggaggttccttaaaaatttttgaatggaactaccatatgatccaataatccacttctgggtatatatccaaaggaaatgatatctgcatgtcaaggtatctgtactcccatatccattgcagcattattcaccatagccaagacatggaaacagcctacatgtatgccaatggatgaatgaataaagaaaatgtgagatatagatacacacacacacacacacacagacacacacacaatggaatactgttcagccttaaaaaataaggaaatcctgtcatttgcagcaacatagatggacctggaggacattatgcaaagtgaaataagccaggcacagaaaaacaaatactgcttaatctcacttatgtgtggcatctaaaaaagtcaagcttgtagaagtagcagaatggtggttaccaggggatgagagagaaagaattggaagattttggccaaaggatacaaaatttcagttagacagcaggaataagtgcaggagatctattatactatatggtgactatagttaaaaatatatacttgaggccaggcactgtggctcacacctgtaatcccagcactttgggaggctgaggcaggtgggtcatctgaggtcaggggtttgagaccagcctggcccacatggtgaaaccccatctctactaaaaatacaaaaattagccaggcgtggtggtgcatgcctgtaatcccaactactcaggaggctgaggcatgagaatcacttgaacccgggaggcagaggttgcagtgagccaagattgcatcactgcactccagcctgggcaacagagcaagaccctgtctcaaaaacaaaaacaaacaaacaaacaaaaatatatatatgcttgaaaattgctaagagagtagattttagttgttcttaccacacaaaaaaataagtatttgcggtaatgggtatatatttgaggtaatggatttgttaattagcttgatttagccattccacaatgagtacgtctatcaacacatgttgtacatcatgaatatacacaatttttatttgccaaaaaatgtttaaatatgccataagtaaattaaataaaatatatttcttagaacattatttataaaaataaagcaaaaaaccagatctgtccaaatataactaataaactgactctcattatttaacactcaagagttggctggtatcaggattttcataataccatggccattaaacagttttcgtgaatccaggccttcgttacccatctcttctgcttcttcctcaccttactgacttctttctcatgtacacagagtgcggaatatctgtctcatgagtcaccagcctttgggcagaacccaaaaaattaggtgaactagaaatatattgttgctaagtggctcggtttatcagacaattctaaaatgcctactaggctgcctagctgcatacttttctgcctaatgtacaggacctccatcttgtgactgtcaaaacaggctcctaaattattttgcatcatttggtgacaggcagtctatactcttgtgcaaccaacaggtgcccaataaatgcttggaatatgcaaggaacttggcattgtttaatataattgaaaaagcaagcatggactttgaaactttcctgaatttgaattctgtctccactccttatcacctttaagaatttagggcctggtgcggtggctcatgcctataatcccagcactttgggaggctgaggcgggtggatcacttgagatcaggagttcgagaccagcctagccaacatggtgaaaccccatctctactaaaaatataaaaaattagccgggcatggtggtgcatgcttataatcccaactacttgggaggctgaggcaggagaatcgcttgaacccaggaggcagaggttgccgtgagccgagatcccaccattgcactccagcctgggcaacaagagtgaaactccatctaaaaaaaaaaaagaatttagggaagttattatcttcctgcatctcctttctcctcctatgtaaaatgaaaataataatgtctaattcataagcgtttcataaggatatgatgaaagcccgatgcagtagctcacgcctgtaatcccagcactttgagaggctgatgtgggtgggtcacttgaagtcagtagttcgagactagcctagccaacatggtgaaaccctgtctctactaaaaatacaaaaactagctgggcatggtggcatgcacctgtaatcccagctacccgggaggctgaggcatgagaatcacttgaatccgggaggcagaggttgcagtaaggcatgatcagtctgttccccactctagcctgggggacagagggagactcagtctaaaaaaaaaaggtggtggggtgggatgatatatgtatgtatactactaccttgttcatggtgggagtcaaatataattttatttatagaagtgctccacaggatgatcctggggcttatttagaagttgttctacataggttaactagtgctcagcatagaatttttcattgtttaaatcaaaaactcttatctactggaaacctgtaggttcaggaacaacagccaattaaacagaatttttttttactggcagtttcttcagcattttcctcactatagaatactaaggaaagtgtatgttatctcacaggtcgcaggacaaatgtgtagttgcaatataggatggaggatccagccttgcctcaaatggagagcaaactcaggagctatgtctcatttaattaatgcaaatagtgaacaaacttatgcattattagcaattaactataagactgttccttagagtacaaagtacttttattgtaatcaaaacttaacaacaaggttaatctgatgcatatttaataatatatgtaattgttatggtgttgcatgataattaggccctacacgttaaattgtttacataaatgactgtaattggttatttttacacagccaaacacataaaacttttgcctgcttattttattaattttctagattctataatcatgccaaagacaacagtttatctgaaatcctttactacttaatcatgcagtgacaaacacactattcaaaatgacacagcagggtttcccttggtactgaaaatagctactattcaaggctttctgtatatattctgtcatttaatccctaagaaaccctctacgggtttactcgtattttatggtgttactcccattttactgatgcagagactgatacttaagagaatgtaagtaggcagcatagtggagattcagactactaccacaatccctgacactataccgtctcagaaggtaatggatcacagcagagatatgtaaagttagtttaggagacagagtggctctgaaaaatacagaatatatatagcatatccaaagggagaatgaatcaacctgaaaaagagagaggttagtcagtaatggaaccgtaatgggagggctggggctgacttagtgcccattcaaggaagagagccttggccagtgcatttcaggcattattaccccattatactccactatattatagagatacttatcagactaatgccatctaatatttaaattttaaaactaactcctgttattctaatttctttttttgagatggagtctccctcttgttgcccgggctggagtgcagtggtgccgtcccggctcactgcaacctctgcctcccgggttcaagcaattcttctgcctcagtcccctaagtagctgggattacaggcatgcgccagcacacccggctaatttttgtatttttagtagagacagagtttcaccatgttggtcaggctggtctctaactcctgacctcagatgattggcctcccacctttactgctacttctttctcttaaatctacttctccctttctggattaatgggctcttctctgtcttacctgttgtcatccaagtttctgttcttcactcttccttcttttgtgtttttccattcaatgagttcaagcaatcttgtcttctcctgtggcttccaattttccatcaatctcttgctcactccctcatctgtttaactctgacctgaatgtcccccttggcttttttccatttttttagacggagactccctctgtcacccaggctggaatgcagtggcgccatctcgggtcactgcaacctccgcctcccaggttcaagcgattctcctgcctcagcctcctgagtagctgggattacaggtgctcgccacaatgcctggctaatttttgtatttttagtagagacgaggtttcaccatgttggctaagctggtctcgaactcctgacttcaagtgatccacctgcctcggcctcccaaagtgctgggattatgggcgtgagccacagcacccagcctcccttggcttttgaatccaaaacacataattaacacataattaccaacagatgaataccacgaaggaaatttacactataaaacagtatagaagaatctgatggagtttagaaggtcagactgaggaggtgactattgagccaatatctgaaggaagagtggaaagttaaaccggctaatagtagtgaagaaggggaaagaggatgagagagtagaaacaatattccaggcagacagaacagcatgggacttgaggcaggaaaggagctagtccattgccactgaagctagagaaggggaagagtggggcagaggagactggagagaggcagattatctagggccttggcagtcgtcttgagggttttgtactttatcctgatagcagtgggaattcactaaaagttttttagcaaaagagtaacaagatcaaatctgtattttgaaaaactggttacaatgtggagaattgtatgcagattaaactgaggcaagagagtgtatggggagacagattctgaggatatggtagttcaggccaatgatatgctccctaaacccacttgttttcctaacattactttagtagaaggcaaagacgttaattcttacatagtaaatgtgcgtcgaatattagctattattattatctatagctagagataaaaggcttaaaattaatctaccaggaagaatgagttcattggagtgaaaggatttcattgaaagcatggaaatgcgaatcaaattcttttctttctagaacagagggagggagttagaggagttaaaaagtgataccacaggctggccgcgttggttcatgtctgtaatctcagaactttgggaggccgaggcaggcgaatcacaagataaggagttcgagaccagcctggccaacacggtgaaaccccgtctctactaaaaatacaaaaaattagctgggcatggtggcgggcacctgtaatcccagctactcaggaggctgagacaggagaatcacttgaacctgggaggcggaggttgcagtgagccgagattgtgccactgcactccagcctgggcaacagtgccagactctgtctcaaaaaaaaagtccgggcatggtggctcacgcctgtaatcccataatcccagcacttttggaggccaaggtgggcggatcacctgaggtcaggagttcgagacagcctgaccaatatggagaaaccacatctcaactaaaaatacaaaattagcagggcatggtggcgcatgtctgtaatcccagctactcgggaggctgaggcaggagaatcacttgaacccaggaggcggagattgcagtgagctgagattgcaccgttgcgttccagcctgggcaacaagagcgaaacttcgtctcaaaaaaaaaaaaaaaaaaaaaaagtgataccacaacagctagaagaggaggccaaactgttttttttttttttttgagacagagtctcgctctgtcacccaggctggagtgcagtggtgcgatctcggctcactacaacctccgcctacctggttcaagtgattctcctgcctcaggctcctgagtagctaggagtacaggcgcgcgccaccacgcccagctaattttttgtatttttagtaaagacggggtttcacagtgttagccaggatggtctcaatctcttgaccttgtgatccacctgcctcggcctcccaaagtgctgggattacaggagtgagtcaccgcgcccagcccccattttacatttttttatttgtgcccactgccttttttcagaggatgcagttagcaatttcagccactggatggtgcaaattcacaagagtccagtgaaagttcctcaattacggtccaaggtgcacctgttgctacactgcaccaagtgaaggagggtggggtaaaggaaagactttttggatctgaaatttcagtataaacatggatcgaagttcactagaagttcagattgagggaaatttttagaatttgatcactgacaaatcaggtcattgaataaggaaagacaaaagaaaagtgttgtaataatgaagaggaagagaaaaaggaacagatgatgaaatatgagggaaaataagtctaaagagatgaattcaagtgttagcaacaattatagtatgaccctttactggtttgcatctccctggtaactgatagcaactttgatataaaaataaagcttacttcattctcttctagaaagtcagctatgctacccttagcttatccatttggtggtgtgacattatcaacaaatatttttagtatctgctatgaacatggtgctttgttgatacaaagtaatatagagatatacaaattaacacagatactgggcttcaagcagaagaaccagtaagtacatataagaagataagtaattgactggattaagaaaatgtggcacatatacactatggaatactatgcagccataagaaaggatgagttcatgtcctttgtagggacatggatgaagctggaaaccatcattctgagcaaatatcgcaaggacagaaaaccaaacatcgcatgttctcactcataggtggaaattgaacaatgagaacacttggacacagggctgggaacatcacacatcagcgcctgtcgtggggtggggggatgggggagggatagcattaggagaaatacctaatgtaaatgacgagttaatgggtgcagcaaaccaacatggcacatgtatacatatgtaataaacctggacattgtgcacatgtaccctagaatttaaagtataatactactactactattactaataatagggaagataagtaattcaaggcaacctgagggccattgtgtcaactcagaaaatggaatactttttgaaagtgggagtggagtatcagtgggatggggaggaagggatcataggactctcaacctgtccagggcaaacaaaaaataaaaagatttcttctggcctttagtcataagtacatgcagcaactcttccttggaaaatggctagttatggacatagacataggaaaagtgctctaggtcagaatctgctgggcagtgattagaaagcatccaaaatattaataggagggggtaggagatatgaggaaataatggttaaggccagtaccactcctgaaaccaccgttgcactagcctgggagtacagaaaaggaaggatgttaatggcttgttcaggcctttcagagatccacagtcccaggtcactttgatttttgagattatgggtttatctaaaaaatgaagaaatggcaaaacagagatacaaaatatgttttatattttatttatatttatctttttttttttttttgagatggagtctcactctgtcacccagactggagtgcagtgtcaccatctcagctcactgcaacctctgcctcctgggttcaagcgattctcctgcctcagcctcccgagtagctgggattacaggcatgtgccaccacacccagctaatttttgtacttttagtagagacagggtttcaccatcttggccaggctggcctcgaactcctgaccccagatgatccacccgactcggccctccaaagtgctgggattacaggcgtgagctaccatgcctggctgttgtatattttaagtgtttctgtttaacaaagtaatgcttttaatacacacgcaaatatggctgtttacttaatgtcattcagcaataacttaaaaagtttaaattggaggtttttgtgaatgtaccttctttgccctaagcaactacctatcttaatttttgggcctatcaaaaagtattggggtgacatcaaccctttaaaaaggtggaacagcctaggcgcggtggctcgcgcctataatcccagcactttgggaggccaagatgggcagatcacctgaggtcgggagttcgagaccagcctgaccaacatggtgaaacctcgtctctactaaaaatacaaaaattagccgagcatggtggtgcatgcctgtaatcccagctacttgggaggctgaggcaagagaattggtttgaacccgggcggaggttgcggtgagccgagatcacgccattgcactccagcctgggcaacaagagtgaaactccatctcaaaaaattaaaatttaaaaaaaggtggaacagcttctagtcacctctaaaacttgaaaataaacacaacttcttgaaatgtagtagtaatatattagccaagaagaagagacagattttttttttttttttgaaatggagtcttgctttgtcacccaggctagagtgcagtgacacgatctcagctcaccgcaacctcagtctcctgagttcaagcgattctcctgccttagcctcccgagtagctgggattacaggcgcctgccaccatgcccaactaattttttgtatttttagtaaagatggtgtttcaccatgttgaccaggctggtctcaaactcctgactcaaatgatccacctgccttggcctcccaaaatgcaaggattacaggcatgagccactgcacccagccaaagagacagatttaaagtggtgtgaagaatatgaagttttgtatgtgtctttttattatatgtgtatatatatttataatgtccataaagagatatattaaccactgattacatattaaccagtgttaatgattatctctgggaagagagattaggtattacttttattctttatacttttgagtattttctaaaagcttttataatgagaatgtactttatttattttattatatactttatatatacatattttttgagacagagtctcgctgtgtcgcccaggctggagtgcagtggcacaatctcggctcactgcaagctccgcctcccgggttcacgccattctcctgcctcagcctccctagtagctgggactacagatgcctgccaccacacccggctaattttttctttttcttttttttttttttagtagagatagggtttcgccgtgttagccaggatggtctcgatctcctgacctcgtgatccgcctgcctcggcctcccaaagtgctggggttacaggcgtgagccaccgcgcccggctgagaatgcactttaataattataaaaacaaagtgtggtagcttaataagaaagaacttgcaatagaaacagcaaataaggctaggcacagtggctcacgcctggactttttaccccagcactttgtgaggccgacgcgggtggatcacttgaggtcaggagttggagaccagcctgaccaacattgtgaaaccccatctctactaaaaatacaaaaattagctgggtgtggtggcgcatgcctgtaatcccagctactggggaggctgaggcacgagaatagtttgaacccgggaagcagaggttgcagtgagctgagattgtgccattgcactccagccttggcaacagagcgaaactgcatctcaaaaaaaaaaaaagaaaaagaaaagaaacagcaaataattccacaggaataattggcacttccacagaaacagtgttttatcaagttttgtataacttggtctataatggtgacactagaaatggtgcccagctctgaagtgatctgcagatccacatcccaaagcccacacaggagttctcctttctcctctgccatctctcccatctctgtttttacagatcttcactggaagggaatataggacttgaagttattaatggattagggagtcagaaaatcctcagaggggtctatgctttgtcaggggaaacaaattgtccccaaagcaaaataattttgattctgtctgtgaatttctataaagtcagtacaaatgttacccaaattatactcttttttttttttctttgagacagtctcgctctgtcacccaggctggagtgcaatggttcaatctcaggttcaagcaattcttgtgcctcagcctctggagtagctgagattacaggtgcgcaccagcatgcctgcctaatttttgtatttttagtagagacgggtttcaccatgttgtccaggctggtctcaaactcctggcctcaagccatctgcccacctcggcctcccaaggtgctaggattacaggcttgagccaccgtgcccggcctccaattatactcttgtagaagagttgatgagcgcagattttgccataggttttatctcctgggacatctcatgtttcaggattaagggacattcagtggtgggtgaggctgggaagggtgaggatgcatgtaggcctcagttctggaccaagagcttctaagtatataatgcttttaatcatcctcaccagtggtcttgggaaagagcaggcattttttttcttcctattttattgtcaaactaagtcacagatggcaaaataaacttgaggcaacatcgtggatcagtggcaggatgcaaataatatactcattcatccaaatgccaacctcagtgctgtttcctctctactatattttcaaggtatgctctatggacatttagaggttcttttttttttcttttttttttttttgagatggagttttgctcctgtcactcaggctagagtgcaatggtgagatctcggggctcactgcaacctccacctcccgggttcaagcgattctcctgcctcagcctccccagtagctgagattataggtgccctccaccatgcccggctaatttttgtatgtttagtagagacgggtttcaccatgttggccaggctggtctcaaactccttacctcaggtgatccacccaccttggcctcccaaagtgctgggattacaggcgtgagccaccatgcctggccctagaggttctttggagcttctttgaaacatatcctcattatccatgctttatatgtgttctctttcaggctggacttgaatattaaatcgagccttagggtgagattttcccctgttggtattgttttgataatcactttttggacagcacttgaagtgaaagaaagaaggatacagtttatgtatttttttttttaaccagagaactaagaaaacagaatttcttagaaacagacacatttcaccaaaatgaaatggaatggtttcagactcttaggaaaagaagcagggcctcaccctgtcttatccctcctgacatttcctttttcacctcaacattgattcaagatcaggtggtttcactttctcaccaaactcttatttaagcaggttagatttgactcatagctattctcctgtgagaaacagcattatcataattattttgctctggaatctttgtccaaaaggtatgcaactctctattaaagtatgatataatatcagagccaccttaggaattctggatcgtcagaagacttcacttgggtactaatggtctgtagtccctgaaccccttggggataacttatgaggaaggcttttggaatgcgtagggtcaagttcccttcagcagtgtgtggatagatacatgtagtaccagaagctaaattacaaaaccttataaacgtcaaccagggagatcaggagtcccactctaagctattgagggccagtgagtgtgaagtcagctgtgaagataacagaggagctggaagctatgtcacactaacagctgccttgtttcttagaggctgtgtttgagtcttctgtcaaagagagtagtaaggtccattcatagtgcttgcagggaatactttttgttctcgtttgaggggatggaaaggtatccatttagatggatgtatgaagtgaattacagaaggttgtggctcagataggggcatgagggtaactctgctaagcccacactctcccttcattaaccaggaattggtgtttgattgtaatgtccctgctgaagatacaagtgtgaaattggcaagaatgtgcccatattaatagggagaggactgtgtagtatcattcagtctttgagatagagcagaacttttcagaagtatgtctggtggataacagtgatctctgcagctttctttgggtttgatgaattggcagcatcttgtccaacctagagattgaaaggaaatatgaaagttaaaaaaggatgcaagtgtatagttcttcatgtaccaagaaaagggctggctaagtacaaaaccccatgtaattccaagtgcacttcattttgcctctttgttaatcgataattacactgagaaagtatgatcaaggtgcacataggtatgagaaccaataattgcttggaacctataacccactagcaaagtaattaaaagatctggatcatagttctgtttctaacagctgtgtaaccttgggaagtcacataacctcttcaagcctcaacttaagtatgagtaaaatgtagatacttgccctggctactttccaggatttctgtaaggctcaaatgagataatgtatataagattgctatcttagtactatttttttttgagacagagtctcgctctgtcaccgaggctgcagtgcagtggtgtgatctcagctcaccgcagcctgtgcctcccgggttcaagcgattatcctgcctcagcctcctgagtagctgggattactggcgtgtgccaccatgcctggctaattttttgtatttttagttgagacagtttcaccttgttggtcaggctggtctcaaactcctgacctcatgatccatccacctcggcctcccaaagtgctgggattacaggcatgagccaccacgcctggccctatttttattcctttatcatttagtagcttattgtgttcatagaagttcaatcacagttgcagctacctggttatctctaattctattctggactagactttgtagtcccttcaggcctatttcttccaatgttcaggagaaatgataatttttttttttttttggacacagggtctcaccctttttcccaggctggagtgcagtggctcgatcatagctcattgcagacttcaattcctgagcccaagtgatcctcccacctcagcctcccaagaagctagggctacaggcacatgccaccagctggcttttttttttttctctctttttgagacggagtcttgctctgtcacccaggctggagtatagtggcgcaatctcggctcaccacaacctctgtctcctgggttcaagcaattctcctgcctcagcctcccgagtagctgggactacgggtgcacaccaccatgccccaccaatttttgtatttttagtagagacagggtttcaccattttggctaggatggtctcaatctcttgacctcgtgatccacctgccttggcctcccaacgtgctaggattacaggcgtgagccaccgtgcccggcccagctggccttttatagatatatagatatatagatatatatatatatatatatatataattatgtataatatataattatatataatatattatatataattatatatatataatatattatatataattatatataataaatatataattatatatatttatatataatgtgtgtgtgtgtgtatatatatatatatatatatatatatatatatatatatatacttttttttttaatagagacagtgtctcgctatgttgcctaggctggtctcaaactcctggactctagcaagtctcctgcctctgcctctgcctcccaaagcactgggattgcaggcatgatgaatcaggcctggccttaaaaatcttaaaagtaagattcttgactccaatctaaatgatctgattcagtttatatggggcccagaggtatgtgtattcaataagcaccctattgtatcatgtctggactgatgttaggaaaacagtaggataaaatcctacctatttcctgacataagaaggattgcccacatttgcttcataactgaagcagctccctgttcccagcacattaaaaaaaatattttttcacagtcctcttagggacgaatctcctagcacttatatattaaccccattttctgtttttctttttttctttcttttttttttgagacagagtcttactctgttgcccaggctggagtacaatggcacaatctcggctcactgcaacctccacctcccaggttcaagcgattctcctgcctcagccttccgagtagctgggagtacaggcatgtgccacctggctaatttttgtatttttagtagagacagggtttcgtcatgttggtcaggctggtctcgatcacctcaggtgatccacctgcctcagcctctcaaagtgctgggaatagaggtgtgagccaccacgcccggcccctaccccaccttctttaagcaaatgacataaaccacacagagaacactttccttctggggctgagagtcaggcttggattcagctgtcccaggtggctggcctcccttcttttgccatctccacaaccactggcattggcacagcttcctggctcctaggcattgatactgaagggagaaaatgactggtattaatatgaagtggctggtaagcatttggttttcttccaaacctcttgttgggcaacttaaaggaagccatctcttctaaataaaatattcagtcctattggacctatccttcctagaaaatgtctaagtacagcagaggaaaggaactgcatttagtgagcacctgtgtgccaggtgcctttcacacagaatctcaatctttataactaccatgagaggcaaatatcatgagacttattttacacatgaggccactgaggttagaacagtcaagcaactttcccaacaccactcagctagtgagtgtgagtggcacatctcctcaaattccaaagtctatgcttttctccttatgccaagctgcctctggaacagaagaaagtctttatgggtcaagttcaaggattcaatacaacagcaaacttacaggacatgggacttcaaaaattacaaatactataatggcaactccactgagcaacagggtgacagcaatcagaattttgaccacaatactccatttctgtctcttctctaggttctcatctgtgtctaaaggagagaggggagtggaagagggagaaaagaaaatttgagagaggaaagagattgatcctttgacctgaagttcttctggctcacaagactattagaggcccagactaacccagaggcagaggcagaatttccaattcaaactcagggctggagggggtgtgagggtgagctgagcatcatgggctctgctctaacttcttttgcactctcttcccactgagtcaccttccctggaattggggattttccataatcacatagggctgattcttacactgctcgcaggaagaaaaatctcgggtacacatggagctctaaacttcttttactgtcagctttatcagggttcctaccattttgctctgacacattttatgggattagaaagtcgcctttcctatgtttctcctggctttcatagaatataagaggaagaaatgtaaaaattagcactgcttctgggtcagaagctcaatctggcggcaaatggctaatatgcattttttttctcactctggcactcaagactggcatgcagtggcacaatcttggctcacttcagcctcaatctcccaggctcaaaccatcctcccaccttagcctcctgagtagctcagaccacaggcgaacgccaccatgcccggctaatttttaaaatttttttatacagacagagtctcattatatttcccgctgagcttgaactcctggcctcaagtgatcctacagtcttggcctcccaaagtgctggaatattacaggtgtgagccaactcacctggccctaatgtgcatctcattattactaatatcacatttttcccctggtagaaactaggatgtaacccaaattggaatcttacagaattttagtcctggccaatttaaggaggactgttgctaaaaaaacagtgaagaaggctgtgtgcggtggctcatgcctgtaatcccagcactttgggaggctgaggtgggtagatcacttgaggtcaggagtttgagaccagcctggccaacatggtgaaacccgtctctactaaaaatacaaaaattagccaggcatggtggtgcatgcctgttgtcccagctactcaggaggctgaggcaggagaatttcttggatccgggaggcagaggttgcagtaagctgagactacgctactgcactccagcctgggggacagagtgacactccatcttaaagaacaaaaacaaaaaaacagtgaagatgaaagtatgctgttggaggcccagcgcagtggctcacacctgtaatcccatcactttgggaggctgaggcaggcggatcacaaagtcaggagttcgagaccagcctggcaaacatagtgaaaccctgtctctgctaaaaatacaaaaattagccgggcgtggtggtgcatgcctgtaatctcagctactcaggaggctgaggcaggagaattgcttgaacccaggagggggaggttgtggtgagctgagatcacatcgctgcactccggcctgggtgacagagtgagactccatatcaaaacaaatatatgctcttggggacgggcgtggtgggcaatgcctgtaatcccagcagtttgggaggctgaggcggtaggatcgcttgagcccaggagtctgagaccagcttggacaatgtggtgagaccctgtctctacaaaaatttaaaaattagctgaacatggtggcacacacctgtagtcccagctactcaggaggctgaggtggggggatcacttgagccccagaggtcaaggctgcagtgagccatgtttgcactactgcactccagtctgggcaacacaagaccctgtctcaaaaaaaaaaaaagaaaaagaaaagcacttggttggtgtcatcactcttataattgcttagtgtttaaatattgtccatctatacatacagtggttagaattacctactacagaaatacagttttttctgtccctaattctggcgacagggtgagctcatttgcgtggagataaatgatcattgatggtgtcaaattacaaacatttctgggacctttatagagaagctaattttgttgttgttgagacaaagtctcactctgtcgcccctgctggagtgcagtgggacaatctcggctcactgcagcctccacctcttgggttcaagcgattcttctttctcagcctctcaagtagctggggttacaggtacctgccaccacgtccggctaatttttgtatttttagtagaggcgggttttcaccgtgttggtcaggctggtcttgaactcctgaccacaggtgatccgcccacctcggcctcccaaagtgctaggattacagacatgagccacagcacccggcctagagaagctaattttttaaaataaaaaattgaatgatttttcaatgtacattcagtaacttctcaacctcaagaaaaatatcagtagatccagactaacgctggggctaaaaatgtttcttttctgttcccattttactcctacttattctgtactttgtcatttcaaagctagaaaaattaccggtacttgtagttttctctccttctttattcccaggagttatagaaggggcagtggtgggaaaagtctctgatgaagcccccaggactttacattgtgagatccctggtaaaaaagctataaaacaaagtagaaaagatgaaactttaggggaaaactttatcctgcctttggttttatctgatgaaaccctgcccagctgatagtaaacttccaattgtggtcccattaacctgtctgtccataggtttagggtgtgagcacaaaataatgccaagagtaaatgaggatagagacactaataagagatatggattaaatgcccatgggacttttaactaacataggatcaaagtgaaggagtcatgccaatgatatcattgcctatcattatttaggccataataataataaagatgaaggccataaaaactgttgacagtttccttctttaaaaagagatggctccaaagtccaaggaagaacatgaaatatcacagttagccttaatgactgctgcaagtgtgtctagtagaatctagatcaactactctgagaggggactggggaaagcaggaggagctggaagaaggaaaagccacccagcttcatgtactccttgatttcattcattcagcaatttttttttttttaagacagggtccccctctgtcacccaggctggagtgcaatggtgtgatctcagctcactgcaacctctgcctcccaggttaaaatgattctcatgcctcagcctcccaagtagctgagactacaggtgcatgccatcgcacccggctaatttttatattttttggtagagatggggtttcaccatgctggccaggctggtcttaaactcctgacctcaagtgatctgcccacctcggcctcccaaagtgctggggttacagacatgagccactgtgcccagcctggccttgctttcaaaggatctctgggctactgtgtggggaatgggttggggtgggcaagggtagaaggagggtaacctgttaggaggccattgcaaaagtccagatgagagatgatgtgattcacaccagcagtggaagtgatgggagatggatagagtctagctggagtctggaaataacctcactcgtctccagaattgacctaatccaattcagacagtgtggtttctgttctatttttagtggtctcatatcattgcttattaaattaaggtctataaattctacttgacttttctaaattactcttccatgtcttaagtccatgagaaaatgatagttctttacctcagaggccagtggccatagtaccaggcactgtacatgaaatcataggggaagaggtgatccccgattccagtttaatcaggaagacagtgttggcagacattggcagagacagacataaagtcaacaagttcaaaagaaaaaacaagaacattttcatcatagtgctagtcagttcttcgaagtgataacttacatgtttataagtcacattagataaaaataaacaaatctcactttggacaagtcaccacaagttatctgtgtttttttttttaatctgtaagatggtaatagtaaaataatacttgctctacctatttcacaggggtgttgtgaagatcagaaacaaataaaaatgagaaagcatgtgtgtaaacactttgcaaactgaatgatattatgattgaaagagggggaaaaagatgacctaatgagtcatctgtctccaccagaaggaaattttgaaatattgataacagccgtcttttccttttccaaatttcttaaataataacaaatagtctccatttacctttttctacattccatgttgacccacatcttctgatgagcatttgtattgcagaacattctcacccttacagttccaaatttctattttacttgaggacattttcatgaactgtcttctgaccatttccaggacatcctcctatgcagactgtctgggacaacaggcgcacaccactacacccggctaatttttgtatttttagtagagacggggtttcactatgttggccaggctggtctcgaattcctgacctcatgttctgcccgcctcgggctcccaaagtgctgggattacaggcatgagacaccgcgcccggctctaatttttatttctaccctgtttgaggtttatcacttctggtattgagtggagatttaaattcagaataggaagtttcaaacttgtagaagggattatgtttcaaaagttcatacataaattggttgttttggaccaagtgaggtggctcacgcctataatcgcagcactttgggaggctgagttgggctcaagtgatctcacttgaggacaggagcttgagaccagcctggccaaaatggcaaaaccctatctctactaaaaatacaaaaaattagctgggcatggtggtgctgtaatcccagctactcgagaggctgaagcacgagaattgcttgaacctgggaggcggaggttgcagtgagctgaggttgcaccactgtaccccatcctgggggacaaagcgagactctgtctcaaataaataaataggttttttgggattcatcattatggtttcataaaaatgtatcatgagtgatgattaggtccccaaactaatctacaaatatccatttaatctttttgcatagctcaaatagtacagagtattagcttaaattctagatgtgggaaccaactactatgttatgaaggaaagaggaagagtttctttttctctgggaggctaaccaagtgcaaatttttgaattaggtcaggttgatctttggcatctctcctcccctttaacccctcagttttccttgtcccaatttctaagagctaatgtccttaattgccccaagtctcacaatgcctagcactatattcactccacccagagtgctccaaactccaaaatgacttaagtccacttttccccaacacagctgccatggacagcaaggtgtcacatgttaagagggaaacaattggatttaattaatttgcattaatattcaaagttcaaaaccctgccagagtcttttgagtttgtttattttttcagatggagtctcgctctattgcccagactggaatgcagtggtgtgatcttggctcactgcaacctccgcctcccgggttcaagtcattcttctgtctcagcctcccgagtagctgggactacaagcgcgtgcctccatgcctggctaatttttttattttgttttgttttgttttttgagacagagtctcgctctgtcgccaggctggagtgcagtggcgtgatctcagctccctacaacctctgcatcctgggttcaagctattcttctgtctcagcctcctgagtagctaggactacaggcacacgccaccatgcccagctaatttttgtatttttagtagagacgaggttttaccatgttggccaggatggtcctgatctcttgacctcatgatccgcctgcctcggccttccaaagtgctgggattacaggcgtgagccaccgcacctgacgcttttgagtttttaagagtttttctgtaacatcctgagagcctatccacttatttcccagttttagtctagagtttaaagttttttccattattctgcttgtggatccccaatttctctaaaaatgtcaagttttattttatttttccagtaatgtagcaatagcatctaggggactgccagtttataaagaggaaccggctacactaaagaaaaaaaaaaactatatgaaaaaaagaaagggtgagaaaaggaaaggagggcagaaggagagaaacttcaggctgaggttaagaaccactgtccagcagctgtgggggaataggcattctcccccagtgtggatatgcacaatggaaccaacctctagtgagggtaatttagcagtaactatcagcctttgatgcaacaatcctgcttcttggaatcttattgataaattgataaatcttattgataaattgcaggtatacaagaagaatatatatagatactgagtaatagtgaaagaggggaaaagaatttattaaaagaaaaaagagaaaaaagaagaatatatacggtcattgttttcggaattgtttgtatttgcaaaagattggaaacgaccaaaatatatatcaatagggggctagtagaatatagaagagacatggccgggtgcagtggctcacgcctgtaatcccagcactttgggaggccaaggcgggcagatcacaaggtcaggcgatcaagaccatcctggccaacacggtgaaaccccatctctaccaaaaatacaaaaaattaactgggtgtggtggcgagtgcctgtagtcccagctactcgggaggctgaggcaggagaatggcgtgaacccgagaggcggagcttgcagtgagctgagatcgcaccactgcactccagcctgggcaacggagcgagactctgtctcaaaaaaaaaaaaaaaaaaagactatggaagagacatactatggaataatgtaaaactgttaaaaagaatgaggcaaatataaaaaagtatggggtaaatatatacgtattgaaatggaacgacctataagatatattattaaatggaaaagcaagggattggccaggcgcagtggctaacgcttgtaatcctagcactttgggaggctgaggtgggtgaatcacttgaagtcaggagttcaacactagcctggccaacatggtgaaaccttgtctctactaaaaatacagaaattcactgggtgtggtggtgggcacctgtaatcccagctaattggaaagctgagacaggagaatcacgtgaacctgggaggaggaggttgcagtgagacgagatcgcgccactgcgctccagcctgggtgacagagtgagactccatctccaaagaaaacaacaacaacaacaacaaaataacaataacaacaaaaaacaaaaacaagcaaaagcaaggggcagaacagtgtatatggtatgttaccatttatgtttttaaaatatgcacattcatacattcttagagtatctccggaaggaaatataataagttgataatagtggttccatcagggatagagaactggagaattgagagacaggagtaggagagagacttacttttcactataaatctatactgtttgaatattttactgtgtgcatgcaaaatgaaatttaaaaaaaaaaaaacctggccaggcacggtggctcacgcctgtaatcccagcagtttgggaggccaaggcgggcagatacttgaggtcagagatcaggacctgcctggccaacatggtgaaatcctgtctctactaaaaatacaaaaattagccagccatggtggcagacacctgtaatcctagctacttgggaggctgaggcaggagaatcactttaacctgggaggcagaggttgcagtgggccaagatcgcaccactggactccaacctgggtgacagaacgagacaccatctcaaaaacaaaaacaaaaaaaaagaaattttaaaaaactgttgaaagaagatccatcagaaatggagatcacatgaaaatcacagagtatcagggctagaagggatcttagagattataaaactgactctcagagagcacgtagatttgcccaaggggaggataattcattttcttttttttttcttttattattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtctgatgttccccttcctgtgtccatgtgatctcattgttcaattcccacctatgagtgagaatatgcggtgtttggttttttgttcttgtgatagtttactgagaatgatgatgtccaatttcatccatgtccctacaaaggacatgaactcattgttttttatggctgcatagtattccatggtgtatatgtgccacattttcttaatccagtctatcattattggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatgtcctttgcccactttttgatgggagaaaattttcgcaacctactcatctgacaaagggctaatatccagaatctacaatgaactcaaacaaatttacaagaaaaaaaacaaacaaccccatcaaaaagtggataattcattttcttgtagcttttcctgctacggagttctggctgccttcaaggatgtcaactaaaagttagtgcctgcccccttcctcttttccaatctcacctttgccttttagaagagatccagtctgaaacttggatgtggggattaggtgacagcttgaggaggcagagctgtttctgcggggagcagcaatgattctcaggttcttcaaaatatgcttgacctttggccttctctccaaatatacaaggttgacttttactttgctgtcagagccaaggcactgcagggtagctatagtccggttttgaatgaatgttgtccttttggtttctgtgtgagtttctggaaggagaagaaccagatagaaaaatggagctggttttgttttttgtttggttggtttttttgagacggtgccttgctctgtcacccaagctggagtgcagtgtcgcaatcatggctcactccagcctcaaactccctcgatctccaagcaatcctcccacctcagcctcctgagtagctgtgactatgggactacaggtgtatgccactttgctcggctaattttttaattttttaaaagacagggtcttgctgtgttgcccaagctggtctcgaactcctgggctcaagcaatcctcccaccttggcctcccaaagtgctgggattacagacatgagccaccgcacccgaccttgaagcgtttgctcttgtggtccaggctagagtgcaatggcacgatctctgagttttgctcttgttgcccagagttttgctcttgttgctcaggctggagtgcaatggcgcaatctcagctcactgcaacctccgcctctctggttcaagtgattctcctgcctcagcctcccaggtagctggggttacaggcgtgcaccaccacatccagctgatttttgtatctttagtagagatggggtttcactatgttggtcaggctagtctcaaactcgtaagctcaagtgatccacctgccttggcctcccaaagtgctgggattacaggtgtgagccaccatgcctggccaaagctggtttttaatctgaacagtgccaagctaacccatttccattcatgacccctgctaaactccactgctgtactttctctccttttagttaacttcttcagtttgtgttcatagtactaatagacaagtcctgcctttcttctgccatggttcccatgaaggttggtgacagcagtaaatttagcacagagaaatgctcatagatttttctttaatgcagagaggggtaggttctgcctccttctcttttttcatctccatccatttgagtaatataagcatgccttaggtaatgacagttaatttaaagattggtttccagaaagccccctgggaggatacatatccttaaaataggatatttgagatatgggctaggaagtgggaagatgagatatcttttaaaggtaaaaattttttggaatggcaatatcattttccagaaaggacccattccctaccttgcatttgcaattctctgatgcttctcacgtcttttgggaagatcccaggcagctgttccagtcggcaactgctatctctgaggtctgggggtgagcagagggggaggaggggaaccggggaaggtttggggaaaatcagaatttactggtacttactttttagaattctgggcaatggagaagatatgaaagattgcagttcctgctcataaaacttgcaacttgggagatcaaacactctctaaaaagactttacttttatttatttatttatttatttatttatttatttatttattgagacggagtctcactctgtcgcccaggatggagtgcagtgacgtgatctccgctcattgcaacattcacctcctgggttcaagggattcttctgcctcagcctcccgagtagctgggattacgggcatgcaccaccatgcccagctaatttttgtatttttagtagagatggggtttcgccattttggctatgctggtctcaaactccttacttcaggtgatccacctgccttggcctcccaaaagtgctaggatgacaggtgtgagccaccacgcccggccctcaaaaaagaacacccagccaaatacatacaaagtagtagttgacctagtataaagaatactgtgtaccaatctattacccttaggacaaagaaaggtcaaatagagttaagaaaatttactaagttaatgaaagtctaaccaacccatttccttaaatactgcttattttctcttctccctcctattctgtcttctttcttgtattaaataaagcttttggagatttatattgtctgaccttggtatctctataggtttccacagaaccataggtcttagttatttatgctttttggcacataattcaaagggttgtgacatttttataatttgtcaaattcgttactgctgcactttgtgccatttggtcttaattctgattagctaattttatttttttattttaattttttattttttgagacagagtctcattctgttacctaggctggatttcagtggtacgatctcagctcattgcaacctcacctcccaggtttaagtgattcttatgcctcagccacccgagtagctgagattacaggtgcatgccaccatgcctggctaatttttgcacttttagtagagatggggtttcgccatgttggccaggctggtctcgaactcctgacctcaggtgatccaccaatcttggcctcccaaagtgctgggattacagtcatgagccaccatgcccagccttgattagctaattttagagatgaaatgtttatgaaactttgaaaactcatattttaaataagcagttaccaaagagcagcaaatgatgccattccacccaatatcaccctttccctcagctctccccacccaagaatatcaccgtctagctatttacatgtaccaacttaaaaaaggcaacatcttatgaacagtatgaatttgggaaccttaggtgatgacaatactgaaactctaaagaaagccatccaacagtgaaaggacttttaatgttaattacatgaacaagacataagaatgcatcacattctctgaagacctctcatcatgaaacagacagctatctctctggaatgaataagttgcagtccttcttagaggcgagtggatacatgggattaactctggaaagtattgcttgctggatatcagctacatctctatctggtggaagagaccccgaaactctttctaggcctctctctgtattttccaggagattaggctagagaattacatacctttcttgttggcatcataggatgcaatgattaggctgaagaccaagatggtatccatgttagcttgagcacatgctcattgcagacagaccactgctcatctgtcacagcccttgatagctctgcctctagttgctttcaccacacgcagctggaaccaagtttgaccctgagagactctgattccaccctgattattttgccccatttcctgaagacccaggaatagatctaattggagaaagggctaattctgcttattaataattcactcagacttcttctgacttcgctgccggtgccgacatagagaactagattacctagaggtttctcgagcaggaaggccataaacgcccattgatatgctttacaaatacttgcagatagacacgtagacatttacatgcatgctcactgacacaggcacagagatttatatactttcatgaaaagatgtggagatttctagtaaggaatataatttctagagcaggaattatagaaatagagcaggaaactaggactaggagtcagtacaattgagttctagtacaggcccttttatgagctatcaccttgagaaaattacttgacttcttgggatctaaatgttctcttctataaattgagagtcctgaaccatatgatctcttttttttttgaggcagagtctcgctcggtcgcccaggctggagtgtagtgacacgatctcggctcactgcaagctctgtctcccaggttcacgccattctcctgcctcagcctcctgagtaggtgggactacaggcgcccactaccatgcctggctaatgtttttgtatttttagtagagacagcgtttcaccgtgttagacaggatggtcttaatctcctgatctcgtgatccacctgcctcggcctcccgaagtgctgggattacaggcatgagccaccgtgcctggcctttttttttgtgaaatggagtctcgttctgttgcccaggctggagtgcagtggcataatcttggctcactgcaaccttcatctcctgggttcaagtgattctcctgcctcagtctcctgaatagctgggattaaatgtgtgtgccaccctgccggctaatttttatatttttagtagagacaggtttcaccatgttggccaggctggtctcgaactcctgacctcaagtgatctgcccccatcggcctcccaaagtgctgggattacagccgtgagccaccccagccggccctgaaccatatgatctctagaattaatccagttatatatataaactcacattagcacagacatacctattgagttttgcacatcttcacactcctgaatagtgaagtgagtattggtggacaacattctgatgaccattgggctgagaggttgtgaggaagagctaaatacggcaggtgagtggtactgtctgtggcttgggaaggttttcctagacagataactgttgttgaagatttttccaaatttgtatttttttagtgtctagtgtaataatctgtagactttgtcatggcatagatagatggagcataaaagagaatgaagggccgggcgcggtggctcacgcctgtaatcccagcactttgggtggctgaggcgggtggatgacctgaggtcgggagttcgagaccagcctgaccaacatggagaaactccatctctactgaaagtacaaaaattagctgggcatggtggcgcatgtttgtaatcccagctacttgggaggctgaggtaggagaatcgcttgaacctgggaggtggaggttgcagtgagccgagattgcaccattgcactccagcctgggcaacaagagcgaaactccgtctcaaaaaaaaaaaaaagaaaagaaaaaaaagagaataaagatctaccccatctttatcaaactctacagcttctttggtcttgttttattttggagatgggctatgttttgtagagacacagtctcactgtgttgcccaggttggtctcaaactcctgagctccagtaatctgcccaccttggcctcccaaattgctggggttacaggtgtgagccactgcacccagactagaaaactttttaaaaaagttttgctatgagaaagaaagcagagaaatgaggccactgactagagggaacataaatgcctcacatctttattggtccaaggaaatctttattcatcctccccaccctcttgcctctggctgcctgcttctcttagcagaggaggtggttagggcagaggggctccattgccttccttgggttttgtgatttttgcttactatttccttaacatgatgacatgattctctgctcccctgaggtattatcaccttccctcctgttgctctatttgaaactctctgtacattagttcctagatgccacggtacaatgctgccaccttggagcaggagtaggaattgatctgagggcttgctgttctcatccagtgtcacaaggtggcaaaagagctcacttttcccaaaagagaccttgtgcttggcgaaagatgaagtctaagagttttctttgatcacctcgcagaccctacccttttcttttgtaacttaaagactctaaagtcagcctgggccaggcacggtagttcacacctgtaatcccagcacgttgggaggccaaggcgggtggacacttgaggtcaggagttcaagaccagcttgactaacaaggttaaaccctgtctctactaaaaatacaaaattagccaggagtggtagcgcatgtctctaatcccagctacttgggaggctgagacaggagaatcatttgaactcaggaagcagaggttgtggtgagccaacagcacaccactgctctccatcctaagcgacagagcaagactccatttaaaaaaaaagtcagcctgcatattggagtaggccatactgtcgggggcagagcggtggaagagctgcagtcaaaatatccaggagtaggccgggcaccgtggctcacgcccataatcccagcactttgggaggctgagtcaggtggatcacgaggtcaggagttcaagaccagcctggccaacatggtgaaaccccatctccaccaaaaatacaaaaattatctgggcgtcgtggcacatgcctatagtcccagctacttgggaggctgaggcaagagaatcacttgaacccgggaggcggaggttgcagtgagccgagattgcaccactgcactccagcctgggtgacagtgcgagactccatcctcccccaccaaaaaaaaaaaaaatccaagtgtagacaaatagatccatgtttctattatttctaatagactatttctctactcctagatattttgactgactttctaagcatttggaatatcagtggagcagagtatatctcttctgatctccttttcccacaacaaaaacatcaaatttagcaggaaaaaagttatgagttttatgacatatgcagttcagagatatggcgttggaagagagtaggaactaggaccaaatggatgaatcaggatgggtctgcagaaggagcacttgacaggaagccaggaggcctaccctaggctctttaattgactaaatcaatttgaacaggtcacttgtcttctcttggcctctatttcggtttctgtaatgaggtggttagacaaaatggcttacaaggcctcttctagctttaaaattattgtacctgcacactatgctactctttttttttttttttttcgagacagagtctcgctctgtcgcccaggctggagtgcagtggcgcgatctcggctcactgcaagctccgcctcctgggttcacaccattctcctgcctcagcctcccaagtagctgggactacaggtgcccgccaccacgcttggctaattttttgtatttttagtagagatggggtttcaccgtgttagccaggatggtcttgatctcctgacctcgtgatccacctgccttggcctcccaaagtgctgggattacaggcgtgaactactgcgtctggcttatgctactgctttttaaaggctgcatgccattttgttcatttgttttggtttgtttttaaatttaaaaaatttaataatggaggcagggtctcagtatgttgccgaagctggtcttgaactcctggctcaagcagccctcccaccccagcctctcaaagtgctgggatcatagggatcagccaccagcatggccattttatttctttatttcttttcctttatttttttttgagacgtagtctcgctgtgtcccccaggctggagtacggtggcgtgatctcagctcactgcaacctccgcctcccaggttcaagccattctcctgcctcagcctcccgaataggtgggattacaagcgcccatcaccacgcctggctaatttttgtatttttagtagagacggggtttcaccatgttggtcaggctggtctcaaactcctgacctcaagtggtccacccgcctcagcctcccaaagtgctgggattacaggcgtgagctactcggcctggccgcggccgttttttaattgtggaatataccatatatacaggagagtatatagaacataagtatattttcaataataataataatactgaaaaggtgaacatatgttaccatcacccaaattaagaaattgaacattgccagcatcatggatgctctttacatgtctgtgcctctggtcctccggtctctttcctcctcccaatctttatttttccatgttttgtaaaatcattgaactatcagccgggcgtcgtggctcatgcgtgtatcccagcactttgggaggctgagttaggtggatcacctgaggtcaggagttcaagacacgcctgaccaacatggagaaaccctgtctctactaaaaatacaaaattagccaggcatggtggcagatgcctgtaatcccagctactcggggggctgaggcaggagaatcacttgaacgcgggaggtggaggttgcagtgagccgagatcgtgacattgcactccagcctgggcaacaagagtgaaattccatctcaaaaacaaacaaacaaaaaaattgaactctctatatatgtatcactaaaaatattttgtttacttttgaatgttatataaatggaatcaaactctatgtattttttttttttttgagatggagtcttgctctgttgcccaagctggagtgcagtggcataatctcagttcactacaacctctgcctcccaggttcaggcgattctcctgcctcagccttccaagcagctgggattacaggcatgtgccaccaagtccggctaatttttgtatttttagtagagacggggtttcgccatgttggccggcctggtctcgaactcctgacctcagggtgatccgcccacctcagcctcccaaagtgcagggattacagggatgagtcaccgtacctggcctaatttttatttatttatttatttatttatttacattatttttggagacagagtctagctctgtcacccaggctggagtgcagtggcacaatctcggctcactgcaacgtccacctcccgggttcaagcaattcttctgcctcagcctcccaagtagttgagactacaggcacacaccaccatgcccggctaatttttttttttttttttttttttagtaaagactagttttcaccgtgttgcccaggctggtcttgaactactgagctcaggcaatccgcctgccttggcctcccaaagtgctaggattacaggcgtgagccaccgcgtctgggctggaaatttcttttatgtgttctcccagtcactcctcaccatcaaaagtaaatattatcagctggacactgtggctcacacctgtattcccagtactttgggaagctgaggcaggtggatcacctgagctcaggagttcaagatcagcctggccaacatggtgaaacaccgtctctactaaatatacaaaaattagatgggcatggtggctcatgcctgtagtgcagctactcaggagtctgaggcaggagaatcgcttgaacccaggaggcagaggttgcagagccgagattgggccactgcactccagccttggtgacagagtgagactctgtctcaaaaaaaaaaaaaaaggaggggccaggcgcagtggctcacgcctgtaatcccagcactttgggaggccaaggagggcagatcacctgaggtcaggagttggagaccagcctggccaacgtggtgaaacctcgtctctactaaaaatacaaaaattagatgggtgtggtggtacgcacctgtaatctcagctactcgggaagctgaggcaggagaattgcttgaacctgggaggtggaggttgcagtgagccaagattgcaccactgccctccagcctgcagttacagagcaagactccatctcaaaaacaaaacaaaaaaaagaatgtattatccagattcttgccatcacaaatgagttttgcctatttttttttttctagaaatggggtctctctctctctgtgtgttgcccaggccagatttgaactcctaggctcaagtgatcctaccatctcagcttcctgactagctgagactacaggggcatgcacctggcttgttttgcccatttttttgttgttgttttattttgacagggtcttgctatgtcacccagcctggagtggaattgtgtgatcaagactcactgaagcctccaactcctgggctcaagcaatcctcccacctcagccacccaagtagctgggactacaggcgtgtatcacttgcccagctaaattgtttataatttttgtgagatagggtctccctatgctgcccaggctggtcgcgaactcctggcctcaagtgatcctcctgctttagcctctcaaagtgctagaattataggcatgagccactggtacctggcctgttttgcctgtttttgtagcaggaaacatacattttttgctcaacattatgttggtaaaatccatccgtatttcttcatgtagcaatcatctgttcattctcattgctttataatatttcattgtatgaatgtatcacaatttatatattcattctgctgttgagagacatttgtgttgtttccagtttgtagccataatgagcaatgtttctggggcagttttgaaagtttctccagggtataaatccagaagtagacgctggttatagggtatgtagggtatgtacaactttaccaattaatgccaaactgttttctaagggattgtcctcattacactcctacttgtaatatatgcaggttcctactattacacatgcttgccaaaggggccaaagaatctttcctgtgtgatgcaataataagcctgagtggggccaggcatactcacacgtgccagccctttggttggtactcagaagctcaggccacagtcatttgctccttccaagtaagggtaaaggattcataatatcccaaggtccctgatcacatgctccattaacctggaaatattggggcggatgggttggtgaactgaattttcattttattattattatttttttagatggagtcttgctcttgtcacccaggctggagtgcaatggcgcaattttggctcactgcaaccaccaccacctgggatcaagtgattctcctccttcagcttcccgagtagctgggattacaggttcccgccaccacgcccagctaatttttgtatttttagtagagacagggtttcaccatgttggccaggctggtcttgaactcctgacctcaggtgattcacccaccttggcctcccaaagttctgggattataggtgtgaaccacagtgcccagccactgaattttttatttatttattttttgagacggagtctcgctctgtcacccaggctggagtgcagtggtgcaaacacggctcactgcaacctccgcccctcgggttcaagtgattctccttcctcagcctccctcatagctaagacagggcctccactctgttgctcatggtgggtgcaggaggcagtgaatttagtaatgacacaattttttgtttgtttgtttgtttgagacggagtctcactctgtcttgcccaggctggagtgcagtggtgtgatctcggctcactgcaacctccgcctcccgggttcaagcaattctcctttctcagcctcccaagtagctaggactataggtgtgtgccaccacacccggctaattttgtatttttggtagagacggggtttcatcatgttggccaggttcatcttgaactcctgacctcaggtgatccacccaccttggcctctcacagtgttgggattgcaagcataaaccactgtgcccagcaatcacaatttctgaattaattgaggatccataaagcattctgttctgtatcgattactaataggaaatgaaaggaaaggaacatggagagaaaggggaaagtaatattttctgtgtgcctactatctaacaagctctgtgccagaagcttaacatgttggttacatcatttaatccaaaacaccaccttagaaggtaggctttatatcctgaatataagatagatatatataatatagataaggaaactgaggctcagaaaggtgtcagttcctcaaggccacagagctaattagcgacagagtcaggatttaaagcatagcctgattaaagagctcaagctgtttataatacagagcacagagaaggtagagttgctgccgctcttgagactgacactgccaataccaagaatcggttcttctcagttttgcttgcctgtattcacccgcaaaactatgttattcaactgattatgaccatcttgttcattgattgaagctacatttccttttcatggattttttgttgtctttattctttcttctttttttttttttctttttccaataagaaaattgggcacatcagcacaataggtccactgataaacaagacttgtgttggaaaataactttctacctgcaggtctaggagttaaccagaggtgagatgatatatatatatatatttttttctgagacgcagtcttgctctgtcactcaggctggagtgcaatggcatgatcttggctcactgcaacctccgcctcccggattcaacggattctcctgcctcagcctcctgagtagctgggattataggtgcctgccacaacacccaggtaatttttgtacttttagtagagacagggtttctctatgttggtcatgctggtcacaaactcctgacctcaggtaaccctattgccttggcctcccaaagtgctgggattacaggcatgagccaccacacctggcccagaggtgagattttttttttaaaaagacgtgacattgtggccaggtgcagtggctcacgtgtgtaatcccagcactttgggaggctaaggcgggtgggatcacaaggttaggaattccagatcagcctggccaaaatggtgaaaccctgtctctactaaatatacaaaaattagccaggcgtggtggcaggtgcctgtaatcccagctacttgggaggctgaggcaggagaattgcttgaacccgggaggcagaggttgcagtgagctgatatcgtgccactgcactccagcctgggtgacagagtgagactccgtctcaaaaaaaaaaaaaaaagacatgacattgtgaaatcttctgctctaagatatcacatacaggaaaattttaagacaaggtattaaaaggataaaaagaaattgaatgatggctcaatttttcttgacgataaaggctctacaaaattattaatgttatattttattatgtattgtgtttcatatataataacaacaatagagagtgaaggtagaagacaggtagaggcctaaatatgtagcaggaaaaacctgaacctgatataggaatgatggagacactagggaagtctaaagagaaggtagggatggggcaggaaatcaacttaccaggagcaccgtcatggctttagaggaaagtgaagtcagggatggctaggctataaagctgatcaacataaaatgtcagaatcctacgactgggcaaaatccaaacaagtcatcttgtccattttcctgtttttaaagagccctttaaaatttctccaggtattttagttgtgaggtgtgtaggacttagaaagggatcttaaaaacatatatattggaggtgtcatggaggaagaagttaagatttggtaactggctgaagtatagagactggaagtgtttgccattggataaggaaggagtgagagcagaaatgccatgtgaaaaccctgtgtccatgtgaaaacatcgtggggagtctctactactcatgctgtccttcattgtgcaattctacctttcatcattaggaccagacttatgaagtggccttcctgaggagattttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcaggtacagagctaatctttatttcagtcaatgaagcgcttactaatagaaatacctagtcctacttgaagagctataaaagggggtagcaaactataagagatggtctctgccttcaggatttaactggagagctaaaaccagtatgcagacaaaaaaatatatcctaattaaattctgaactgtgggccaggcatggtggctcacacctgtaatcccagcattttgggaggcagaggtgggaggatcatttgaggtcaggtgtttgagaccagcctggccaatatagtgagactctgtctctgccggaaatacaaaaattggctgggcatgtgattccagctactcgggaggctgaggcaggagaatcacttgaacccgggaggcggaggttgcagtgatctgacagcacgctactgaactacagcctgggagacagagcgagactctgtctcaaaaaaaaaattctgaactgtgtggtatgaccatattgctacaagaattcaaaggagagagagatcagtgaaagctggagaagtaagagaaatcttggagaaaatgggacttccaaggactagaaagattcagaaaaataggagaaaagttggacaagtctgccaccataaacaaaggtataaggataagaataagcatggcaagtgccagaagccagattaaagtatgactattggtggtcagcaggaaataatatcccaataattcctctattctctgtcctaaaaattgatcactgaccttgttatctacgaatttggattcatggtcagacagccccaggacagggggctcttcatggttctattttcttttctttttcttttttttttttttttgagacggagtctctctctgtctcccaggctggagtgcagtggcctgttggctcactacaacctctgcctctcgggttcaagcgattctcctgcctcagcctcgtaagtagctgggattttaggtgcccgccaccatgccaggctgatttttgtacttttactagacatgggattttgccacgttggccagcctggtctcgaactcctgacctcaggtgatccgcccgtcttggcctcccaaagttttgggattacaggcatgagccaccatggctggactcttttcttttttttgagatggagtcttgctttgttgctcaggctggagtacagtggtgcaatctcggctcactgcaacctctgtctcctgggttcaagtgattctgctgcctcagtctcccaagtagctgagactacaggcacgtgccaccatacccagcaatttttttattttttatttttatttttttgacagagtctcactctgtcacccaggctagagtgcagtggcacgatctcggctcactgcaacctctgcctcctgggttcaaacaattctcctgcctcacctcctgagtagctgggattacaggcgcctgccaccatgcccagctaattttttgtatttttagtacagacagggtttcaccatattggccaggctagtcttgaactcctgatctcaggtgatccacccgcctcgtcctcccgaagtgctgggtttacaggcatgagccaccgtgccctgccgcaaattttgtatttttattagagacagggtttcactatgttggccaggctggtctagaactcctgacctcgggtgatccacccgccttgtgttcccaaagtgctgggattacaggcgtgagccaccatacccagcccatggttctattttctattaaggcactttgtttcctcccttgattcaactcaaacctgacttgagagactttcttgtcctaagagtgacaggtattgaaggccttgttgttcaacagagactctggcacacaaagaggggaacaataatgataaatcttaaacgactgttctcaaactttagggtgattaattattagggatgctttaaaaaaagaaaaagtcggccaggtccagtggctcacgcctgtaatcccagcactttgggaggccaaggcgggtggatcacaaggtcaggagtttaagaccagcctgaccaacatggtgaagccgcgtctctcctaaaaatacaaaaattagctgggcatggtggcacgcgccagtaatcccagctacttgagaggctgaggcagaagaatcgcttgaacccgggaggtggaggttgcagtgagccgagatcgtgccactgcactccagcctgggtgacagagcgagaccgtctcaaaaaaaaaaaaaaaaaaaaaagaaaaagagaaagagaaaagaaaaagtcaaccaggtgtggtggcatgtccctgtagtcccagctacttgagaggctgaggtggcaggatcgcttgagcccaggagttgaggctgcagtgagtagttgtgattaaaaaaaaaaaaaagggctgggaatctgcatttttaacaagcaccctggtggttttttttttttttttttttttgagacggagtctcgctctgtcgccaggctggagtgcagtggcgcgatctcagcttactgcaagctccgcctcccgggttcgcgccattttcctgcctcagcctccggagtagcggggactacaggcgcccgccaccacatctggctaattttttgcgtttttagtagagacggggtttcaccacattagccaggatggtctcgatatcctgacctcgtgatccacccgcctcgcctcggcctcccaaagtgctgggattacaggcgtgagccaccgcgcctggcgcaccctagtgtttgtttcatcaggtggtcagtgggacatgctttgagaaacgatgccctaatctaaatatttgaccgaaaaatgccaaatgaagctgtctggacagtggcgcatataatgtttatatatatctgggtttatcaatttttgagaatttatcttttctcatctatggctattacaaattcatatggctatcatctaaagagtgtgacacagacactctgttttaatgtgctagttttgtcttcttaaatagactataatcaccttgaagacagggacctctcatacttttctgactttacccacaggaagataagaaagcaactttaaggttggaaggtagctgggatgctcaggatgagtccctaatacctttacatcaccttgaaaaccctggaagtcatatatttgggattttgtattcgttttctagggctgttatagcaaagtaccacaaactggtggcttaaacaacagaaatgcatttcctcagttctgaaggctagaagtccaagattaaggtgtcagcagttagtttttttctgatattttctccttggtttgtacatggccatgcatgccctatgtcttcatatgtgtgtctgtgtcctcgtcgcctcgtcttataaggacgacagtcatactggattagggcccacccttatgacctcattttaatttaattacctctataaagactttgtctccaaatatactcacattctgaggtattaggggttaggacttcaacaaatgaattttgggatacaattcagcccataacagacctctagtatcagcttctagaaatgtaccactcatccttctcttccatttgttagtctcatatagtaagttctctccaccctttggttctcctcctccgcctcttacagacgtaatagcttgtgtagcaataactcatggagcagctctaaagaacctacagtagggatgggcaggttgtggcatgcaccaaacaccgtaacactcaggggttgctgaaattccagttgtactgtcttaaagacacagctctttgctcattctctgcccagctgtcttagcatttggtgataacaattagattattagatcctctgtaagtgaccttggtatcgtaactcatccttccttaattactttttttttcactgtagcttctattaggactttctttggccagttctttagaaagctcaattatttaaaataatcagtgaagtcaaaagcaggacatgcaggggctggctgaaatttcacataaggacagtttttgagggtaaatccctggttttgcagagcttgtaaagctggtaaacagcaacaccattaagaatcctggggagacttggcgtggtggctcacatttgcggccagcactttgggaggctaaggtgggcggatcacgaggtcaagagatcgagaccatcctggccaacatggtgaaaccccgtctctactaaaaatacaaaaattagctggacttggtggtttgtgcctggagtcccagctattcgggaggctgaggcaggagaatggcttgaacctgggaggtggaggttgcagtgagctgagattgcaccacggcactccagcctgggcgacagagcgagactccatctcaaaaaaaaaaaaaaaagaatcctggggaaagaattcctattacttaagaggatctaggaaaggtaaaagaaaagtaagaggcaaccgcatggtttttagttcttttgaagtcactcccttcatgtcagcttcagagactgctgttatggaaaggcaaggcttccctcttcccaggccatttttttcggtgagtcaaatcaaacatcttactaaaccaggaagtcttgcccaattatctttttcctcccactacatttgtccaactgattgatatattagtgatataattattgtgaaatatgaatccctgttctgtaaagtccacatctttcctaagttctctgcttccaatccctgttatttaattaacttatttatttagagatggggtctttttacgttgccagtgctggggtgcagtggctattcacaggcgcaggcacagtacactacatatagacttgaactcctcgcctcaagccatccacccacctcagccttctgagtaggtgggactacagtccaggtacgtgccactgtgcttgaccctattattttaaaaatgggttgataaattcttagggaagccccacttagtgggattatgagggctcctagataaatattgttccttgttgaccaatctttccctctttctgcctcagcttccgccaagaacttcttacctgggcatgtatttctatcctattcactttttactctctggcgtggaacttcttcctaccaaactgtcatcctctgcacctctcctggccttcctcacaagtttgtaagcattaagaaggtgcgctgcatgcttcattaaattcctccttggaagggctgagttcaccctgttcttctcaagtgcaattttctccaagtttcttccctacgcaatgtttgtattgtgttgggaccccttccagttattattaattttcaacacacagctaccatgaaagtcttgctatgaagtaactggcaaaactagagacaccgactggcttcctctcaaaggctcggcgtgcccacagtggaggacgggaagcattctccaatccgaaaagtctggaacgctgtggcaactattttgctcagggcaggcagaagacggtggttctttggtacattccccttcttactgagcttcgtttactgaggcttctcctcaacacgccaggatccagcatgtataacacctttggagtgggctgtctcggggctgaggagcgaaacggggggctggttatggagttccagcatggggttacttagctcgcccagacttggaaaccagccagcgtgatgaggacaggtagtggacgcgattgcccaccccttgttaatgtgttaggattaaacagacaaacgggcccgcacaccgcctgccccattctagcccgccttaattctgggttccctttccccgcctctacaggccggctagtcctggcccctcacttgggacgcctctgtccctgatgcgaggcgcatgcgggaccgcttcccccactcccctctccgccaggaggaggagccgaggggttggccccgtacccggctgtggcagaaggggccgcgaaggccgggccaggggcgccacgactgcccagggcccgcccgcggcccgcccgcggcccgcccgccctctagccgctgggccccgaatggcagatccgcgctcggaccatcggcatcgcctcacatcgctccgccccgcgccgccctcccattggctgccgctgagccctcgggcccgcgcctcgccccccggcggccctggcagcgccgcagcccggagcggggtcggaggtgaacggcctggagtaaccccggacgtagtcacctcatggagctcgccggctgaggtgggagacaggggcggggcgggggcgggtcaggcccctgaagccccgccccttctccgtgtgccgggccggcctggtgctgcacgcctgtcagccatcgcccgagccgccggcgtctcctcccgcccagcagttcctccacgcaggggctccggaatcgcccgaccgcacacgttgccaccctgaggtgaggtgagggccggcccagaacctgtgaccggggacctggagaaactggggccaagggaggggcggcggcaggcagggggccgcctcccagcctccgctcacccgcacgcggcctgggctccacactatccagatcgggtgcggggcagcccagcccttcccgcagctctgaggccttgaggtcccctccctagagacatggagaggtctggggtctcgggaggtggggattcagatcccggaactgggaggcgtacagttcagggctcctctaggaaggggggctggagtttctgcctggagctcgcccgccacccctcttgcccagctccagcgtggtctgattccttccagacccctctccaatccgattctgggctcgggagagggagaagaccacgtgggaagggggcgttgcgggttgggtctgattgcattgaaagtcctttctctcttgcagagtgaggtgtggggtgcagacctcacttgctctctccgtgcctttgtatcgtggcgagagccagggccaggcaggttgtatctgccagttcctgttcccaggattttattatgttctctgcgagggacatagtaaatgtacatgccttttgttactctcctcgtttgccatgctgatcaagggaagttactggaaataggacgtaggaagctgatgtgaagctaatgatttcacaggaaaatgtgcgtgaaggtcctgcccggatcggggccaacattattttggatttgagagtgggagagtggacactaatggacacttgaaatcacctctaaaaatcagggacttcgtgtaggccttgtgggttctatagagacatttaagaatataactgctcaggagaaatagtttaatttcagatatttttgtttggaggtttaagactggaataaaaaaaaagaccctaggccttcctgattctgtttctacttaagcgatgtttcagtaatttcctaatgtgtggataaacctaataaccacatcttcagtctcagaagtttatttccttggattttctctctctttccattcattttttccctcccaattcggtagtatagattgagaagcatgctttctttggttacatggtcttttctcactcagcagggaagaatactcatatttgtcccttcttgagggggatgccctggatgtctgtgatgagaaggatttctgtggtgcttatttgacaggcacttttcagaaaagcattgtggcctaatagagcaggaccacagtttacctgtccagatagatgcctgcttgctacaaatagcaagttttttcccacttctcttgcctcagtttcttcatttctcagtaaaactgaatgcataacaggaggactgatgtgaacccaagaatattaaacattttaaagtgggcatatgaaagatgccaaaggtaaagtattaatttatgaagccatctgtgtttactagtgttgtagaattttgttgttgttgttttgtttgtttgtttgagatggagtcttgctctgtcacccagactggagtgcaatggtgcgatcttggctcactgcaaccttcgtctcctggtttcaagagattctcatgcctcagcctcccgagtagctgggattacacgcgtgcgccactacgcctggctaatttttgtattttcggtagagacagggtttcaccatgttggccaggctggtctccaactcctgacctcaggtgatccaccctcctcggcctcccaaagtgctgggattataggcatgagccaccacgccaggcttgttttgttttgatttaccagtgcataatagaaatacatcaagcataagattaaattgctttttaaaaaggaagtcttgggaaatggtggcatttatcttagtgaatttatagttcaaaaactaggtaatgctgaagacctggtattgtgaaagccagcctcagagaacgctctctcatctgatgttgacctctctaaagtgctgtgaacaggttcaggtgtagatcactatgtaacattatttcctttgcagtcaatgactaggaaaatttttatacctgtcacgtggactggtttaacaggtttagggctagtgtttttctttctttaaaatctttttttcctttaattggatggctaatatcctaatagtcttagttgaggaaagaagtaaattaaaatacaaactgtggaataatgcattagaaattagtattttcaattgtgggaggagaagagaatccttttgtaattcagaaaaaaaagttatctcattatctaacatgttcctaaagattaacaattatagaagctgccgggcgcggtggctcactcctgtaatcctagcactttgagaggtcgaggctggcgaatcacaaggtctggagatcgacaccatcctggctaacacagtgaaaccccgtctctactaaaaatacaaaaaattagctgggtgtggtggtaggcacctgcagtcccagctactcggaaggctgaggcaggagaatggcatgaacctgggaggcagagcttgcagtgagctgagattgcgccactgtactccagcctgggtgacagagtgagactccgtctcaaaaaaataataataataataattataggagctatgtgtcaagtatctttccaaacccgtaaaacagtaagattacaaaaaagcgaataaacagtagagactcattggctaaaaaattcctattaactattgagataattaccattaatcttctactttaacagattattaacagattattaactggttttttgcttgtttcaatttaattttattttattattttttggagtcggagtctcgctcttttgcccaggctggagtgcagtggcacgatctcggctcactgcaacctccacctctcaggttctagcaatcctgcctcacccccctgagtagctgagactacaaggtgtgcaccaccatgcccggctaattttttgtatttttagtagagatggggtttcgtcatgtcggccaggctggtcataaactcctgacctcaggtggtccgccctcctcatcttcccaaagtgttgggattacaggcgtgagccaccgcatctggcctccattttatttatttatttatttatttgagacagagtttcactcttgttgcccaggctggagtgcaatgatacaatctcggttcaccgcaacctccgcctcccgggttcaagcgattctcctgcctcagcccctcgagtagctgggattacaggcatgtgccaccacgcctggctaatttttttgtatttttagtagagatggggtttctccatgttggtcaggctggtctcgaactcccgacctcggataatctgcccacctcagcctcccaaattgctgggattatgggcgtgagccaccgtgcttggctattttattttatttttttgagacagagtctcactctgtcacccaggctggagtgcaatggtgtgatcttggctccctgtgacctccacctcccatgtgcaagcgattctcctgcctcagcctcccgtgtagctcggattacaggcgcctgccaccacacctggctgatttttgtatttttagtagagacggggattcactgtgttggccagcctggtcttgaactcctgaccttgtgatccacccacttcggcctcccaaagtgctgggattacaggtgtgagccactgcgcctggccactttattttttatgtatttatttatttttttggagatggagtctcactttgtcacccaggctggagtgcagtggtgtgatctcggctcactgcaaccaccgccacccgggttcaagcaattctcctgcctcagcctcccaagtaggtgggattacaggcgcatgccaccatgcctggctaatttttgtatattaatagagatggggtttcaccatattggccaggttgttctctaactgacgtcaggtaatctgcctgccttggcctcccaaagtgctgggattacaggcatgagccactgtgcctggcctttatttttaagtgtttttgatttattatttttttagagattctctcgctgtgtcacccaggccggatggagtgcagtgacgtgatcattgctcattgcagcctcaacctgggctcaagcagtcctccaccttaccttctggagtagctgggactgcaggtgtacaccactgcgcccagctaattttaaattttttttgtggggtggagtgggggtctcgctttactgcctagactggtctcgaacccctggcttcaagtgatcctccgacttcagcctcccaaagtgttgggattataggtgtgagccattgcactcagcctgtttctttaattttaaaaaactgtaatgagtactgtattcgcttgaatctaatggactatttgaaggtgatattaaacaggtaagaaactatgacaaatagtgtcataaggatgttgcacttacactgtataaatctgattgatatggcattaattcttatgagtttagctggccaatctcatttaagtgttctctaatgatgcagttctcttactaatttgttactttttcaagttaccattgggctgtctagtcttaggatgtttaaggaggcaagtgaaaagtggcttcagcaagggctattcagtgccctgcctaaaggttggtggccccagttggtcttgcctttcgatgatgttgagacttagactcattccatccttttagcatgccatactcatgctgttttatataaggaaccacaataatgtttaccattccatgacatcaggactggaaattgcatggcagtactatttatggagtggttatttcagatagaataaaattgtataaattattttctttattttgagacagggtctctctctgtcatcccggctggagtgcagtggtgcaaacatggctcactacaaccttgacctcctggagtcaagcgatcctcccacttcagcctcctgagtagctgggatcgcaggcacatgtcaccatgcctagctaattttttaattttctgtagagatgaggtctcagtgtaatgctcaggctggtttcgaactcctaggctcaagcaatcctcctgccttggcctcccagagttttgggattacaagtatgagccaccatgcccagcaaagttggaaaattccgaatgaactcatgaagtttaaaaaaacagactcagttttggggagtctttctcaagaaatataaggcctcatttatgaatatttggttatcccctttgatagaaatagagtataatactcttaatgaagttcctgtaaaattatcttttttttttttttttttttttttttagacggagtcttgctctgtcgcctaggctggagtacagtgacgtgatctcagctcactgcaacctccttctcctgggttcaagtgattctcctgcctcagcctcctgattagctgggattataggcgcacaccaccatgctcggctaatttttgtatttttagtagacagggcttcaccgtgttggtcaggctggtcttgaactcctgacctcaagtgatccgccagccttggcctcccaaagtgctaggattacagttgtgagccaccgtgcccagcctatcttctttttttataagcatttttcaaatctgttcttagttgtgtatatattttacacacatgccaagatttggaatagtaggttgataggagcttgattagtttttaagtttattaggagtaatatcagtagattagcagcaagaaaatgaattgctgggtcctgttttatgctttagcatttagtggtattcctggccctggcaaggcaagctgtttaattttactttgattctatctcaaaattcaataacttaatagaacatttagtactggaaagtacctaagggattttcttttccagttttccacttaatatgagagaatattttatctgatgtacgtttgaaagtttccaacgataggcacatctggcttaaggcatcacggggcaactgatttttgggagttcttcataattttcaacttaaaactgcctccctaaaactgcataggatgttgtagctacaaaggaattaggaatttttgctttaacctgtaaatgtctccagcatagatctctgttaggtaatataaagtataatgccttaacacatccgtaggacttgaaggcaaaaaaaataagcagtatttccttaaggaagaaatttcttttcttttttttttttgataaggtctcactctgtcaccctcactggagtgtgctggcacagtcatggctcactgtagcctcactgcagcctcaacctgtcaggctcaagtgatccactcacctcagcctcccaagtagcggggactacagacacacaccaccatacctggctatttttttttttcttaattttggtagagatggggttgcgtcatgttgcccaggctggtctcaaactcctgggctcaagcgatcttcctgcctcgggctcccaaagtgttgagattatacagccatgagccagttcttttccttgagactctggttttctctaaatgcagctctatgaaataagattacgagcgtaaattaattcatcctagaactttctgaattcacaaaatggcattttacctggaggcctttaaatgtttctagaggataatgtttgaaataacgacttagtttatgtctcctagttttgtaactcaaatattcgttgcaattctgataaaacatgaagcctggccaggcacggtggctcacccctgtaatcccagcactttgggaggctgaggtgggcagatcacaaggtcaggagatcgagaccatcctgggtaacatggtgaagccttgtctctactaaaaagacgaatgtggtggcaggcgcctgtagtcccagctactcgggaggctgaggcaggagaatggcatgaacccgggaggcggagcttgcagtgagccgagattgcgccgctgcactccagcctgggtgacagagcaagactctgtctcaaaaaaaaaaaaaaaaaaaatgcagcctgtgaaagcctggtgtttacacagcattgtgaggcattgagggtggtggatctaaaacaattagaagaggctgggcacggtggctcacatctgtaatcctagcactttgggaggccaagatgggaggattgcttgaggccagcagtacaagaccagcctcgttaacatagcaagacctccatttctctcctttttgttgtttttggaagagaggataacttttcccagcctcatctaggagataacccagagtcaattacatagtaacacatattaaagaaataagtgaataacatttcagttgtctggctaaatcctctgacagatatgagataagggatcagagtagcatggaattaattgaggaaagctttttattaaacttacttaaaatcttcagttggcaatacattcatgtggttcaacattttattttatttgtttatttattttttgagacagagtctcactctttgtcaccccaggctagagtgcagtggcaggatcttgactcactgcaacctctgcctcctgggttcaagcaattctcgtgcctcagcctcccatgtagctggaattacaggcgtgtgccaccatgcccagctaattttttgtatttttagtagagatggggttttaccatgttggccaggctggtcttgaacccctgacatcaggtgatcctccggtcttggcctcccaaagtgctgggattacaggcgtgagccaccgcacccagcctgtttcaacattttattttatattttattttattttatttttgagacaatcttgctttgttgcccaggctggagtgcagcggtgcgatctcagcgcactgcaatctccacctcccaggttcaagcaattctcctgcctcaggttcccgagtagctgggattatgggcatgcgccacgctccaccacgcccctctaatttttgtatttttaatagagacagggttttaccatgttggccacgctggtccggaactcccgacctcaggtgatctgcccacctcggcctcccagagtgttgggattacaggcgtgggccactgcacctggcctggttcaacattttaaaagcacaaaagggggccatgtacgttggagtacaatggcctgatcttggctcaccacaacctccgcctcccaggttcaagcgattctcctgcctcagcctcccgagtagctgggattacaggcatgcgccaccatgcccggataattttgtatttttagtagagacagggtttctccatgttggtcaggctgttctcaaactcccaatctcaggtgatctacctgcctcggcctcccaaagtgctaggattacaggtgcgaaccaccacgcccagcccgaaacacatttttttgtttgttcattgttttgttttcgagacagggtctcgctcttttgcccatgctggaatgcagtgatacagtcacggctcactgcagcctcaacctcctgggcttaggtgatcttcccacctaagggtcccaagtagctgggactacaggcatgtgccaccacacccagctaattttttctgggtttttttttttggttttttttttctttttttgagacgggttcactatgttgcccaggctggagtacagtggtgcaattatggctcactgcagcctcgacctcctggaatcaagcagtccgcccatatcagccttctgtgtagctgggaccataggcacgtgccattatgcctagcaaatttttaatttttttattttttatagagacggagtctcactttgttgcccagcctggtcttgaactcctgagcagtcgtaatgcctcagcctccgaaagtgttgggattacaggtgtgagccactgtgcctagcctgttgtatacttctattgcatcacatccagtgatgcacacacagagtaaaccacacacacatcatacaaggatgtcagtttttcctaatattggtgatatttagtttgaatacttagttaagatggtatccatcagatttctccattgtaaagatacttttcccttttgtaattaatatgtaagaatatggccaggtgcagtggctcatgcctgtaatcccagcactttgggaggctgaggcaggcggatcacttgaggtcagaagttcgagaccagcctggccaacgtggtgcaatcctgtctctattgaaaatacaaaaaaactagctgggtgaagtggtgggtacctgtaatcccagctacttgggatgctgaggcagaagaattgtttgaacctgggaggcggaggttgcagtgagctgagatctggccattgcactccagcctgggcaacagagcgagactctgtctcaaaaaaaaaaaaaagctatatatatatacacacacacacgcgcgcacacacacacacatatgtaagatatatatatgtaagatatatcttatatacgtatatatgtaaaatatatatgtaagatatatcttatctatatgtaagatatatgtatatataatatatattatatatatgttttatatatatatatatatgtaagaatatgttgttttcactgagcatggtggctcatgcctgtaatcccagtgctctgggaggctgaggcagatggattgcttgaggacaggagtttgagaccagcctggccaatgtggcaaaacctcatctctactaaaaatataaaaattagccatgtgttggggcacacgcctgtaatcccagttacttgggaggctgaggcacgataattgcttgagtctgggaggtggaggttgcagtgagcggcgatcacgccactgcactcacatctgggcaacagagcgagactccatctcaaaaaataataataataataaataataaagaatatgttgttttctgaaaaccctttatccaatagttttaacatatatttacgatatttgccaacatcagttattgcattggtgttttttttttttttttgagacggagtctcactctgtcgcccaggctggagtgcagtggcgcgatctcggctcactgtaagctctgcctcctgggttcacgccattctcctgcctcagcctcctgagtatctgggcctacaggtgcccaccaccacccccggctaattttttgtatttttagtagagacggggtttcaccgtggtctcaatctcctgatctcgtgatccgcccgtctctgcctcccaaagtgctggaattaccacgcccgtatagcattggtgtttgtaaaatgaattatgttttctaattgcatcattatcggaggtaattattttgagattttgctgtctgaaaatatgtcctgtcctcacaattgatcagcaacctattgtgtctaaaattctagattgaaaataattttccttcagaattttgaaggcattgtttaataaccttcaagcttctgttgttatttctgataagtctgaaaggcattcaaattcttgatcatttgtatgtgaacttttttctctcaggaagcttgtaggatcttttcttgtgttcagtttctgaaatttcagtgatgtgccttggtgtctctttttattcattatggtaggcacttgttgggcctttttaatctggcaatgaccatggcaatctggcatgattatcagattaaaatttttgccctttgttttgttcttgcttttgggagcttctgttacttagatatggaccttctgaacaggttctctcatcttctttttctctcctgttgttcatcactttaaatattttttttttttttgagagacagagtctcactcagtcacccaggttgggtactgcaacctctgcctcccgggttcaagcagttctgctgcctcagcctcccaagtagctgggattacaggcgtgtagcaccacacctggctaatttttgcatttttagtatagttggggtttcaccctgttggccaaggctggtcttgaactcctgacctcaggtgatcctcccaccttgccctcccaaagtgctaggattacaggcatgagccaccgcacctggccctctttgactttttattctgatttgtgaaagcttttctttaaccttatcttctgagttgtttcattgctgtgatcatatttttagcttttaaaaattctttcttgttaaaaaattttttttctttcttttttttttttttttttacgtaagtagggatggcgttatgctttgttgctcaggctggtctggaactcctggactcaagcgaccctcctgcctcagccttccaaagtgttgggattacaggtgcgagccgccgcacctggcctaaaatagttattttaaaaatatttcagaccagctgttgtgactcacacctgcagtcctaacattttgggaagttgaggctggaggatcgcttgagcaggaggttgagatcagcctgggcaacataacaaaaccccgtctccacaaaaatcacaaaaaagctagctgggtgtggtagtgtgtgcgtagtcccagctactcaggaggctgaggtaggaggatcacttgagcccttgtattagtctgttttcacactgctgataaagacatactcgagactggacaatttacaaaagaaagaggtttaatgcacttactgtgctatatggccagggagacctcacaatcatggcggaaggcaaggaggagcacgtcatgttttacatggatggaagcaggcagagagagagcttgtgcagggaaactcctgtttttaaaaccatcagaactcgtgagacttattcactaacacgagaacagcatgggaaagacccacccccaggattcgattacctcccaccaggtccctcccacaacacgtggaaattaaagaggaggtttgggtggggacacagccagaccatatcattcagccgctggcccttcccagatctcatgttctcacatttcaaaaccagtcatgccttcccaacagtccctcaaagtcttaactcatttcagcattaactcagaagtccacagtccagagtctcatctgagacaaggcaagtcccttctgcctatgagcctgtaaaatcaaaagcaagttatttacttcctagatacaatggaaatacaggcattgggtaaatgtagccattccaaatgggagaaattgtccaaaacaaaggggctacaggctccatgcaattccataatctagcagggcaatcaaatctttttttttttttagatggagtcttgctctgtcgcctaggctggagtgcagtggtgtgatctcggctcactgcaagctccacctttcaggttcacgccattctcctgcctcagcctcctgagtagctgagactacaggcgcccgccaccacgcccggctaatttttttgtatttttagtagagactgggtttcaccgtgttagccaggatggtctcgatctcctgacctcgtgatttacctgccttggcctcccaaagtgctgggattacaggagtgagccaccacgcctggtctcaatagatattttttcttatcgtttccctcccatctgctaccctcaagtaggcaattgttaatatcttacatagccataatactttttttttttttttttgagagagagtcttgctctgttggtcaggctggagtgcagtggcatgatctcggctcactgcaacctccgcctcctgggttcaagtgattctcctgcctcagcctcccaagtagctgagattacaggtgcatgcctccatgcccggctaaccataatactttagtcaaaactatgaaattaacattggtacaatagtaactaaactataaaactgtatttcctgggttttttttcctctagagatagggtccctctctgtcgcccaggccagagtgcaggggctccattatagctcattgtaatgtgaaactcctaacctcaagtgatcctcctgcctaagcttcccaaagtgttgagattacaggcatgagccaccatgctggccttctgtagcttttcttttttagtgatgtgtttttctattccagtatttaatgtaggataccacattgtatttagtggtcatgtctcattaatctcccctgatctgtgatagtttcttagtctttccatttttgtaatggcttgatgattttgaatagtactcatcaagtattttatagaatgtccctcaattcaaatttgtctgatattttctcatgattaaactagggttatgggttttttgggaaaataccgcagaggtgaagttgctttcccctcccctcgacccctgtagtttttaatggtttcttgttccctgtaatctcttttcttcaagttgcatttttttaatctacaggtagttatttgtttttagtctttcatgttgaagtttttctcagacatctggtaatctttattgtctgtttatatttaagaggaagtgttgaaagctgattagaggtggttagcttactacagtgtaatctggttgggcaactcaattagggacgttgatgttagtaactttagttatttttctctccttgagctggtcagattctccgaagaaggatcctctaggctgggcacggtggctcacacctataatcccagcactttgggaggccgaggcaggtggatcacgaggtcaggagttcgaggccagcctggccaatatggtgagaccccgtctctgctaaaaatacaaaaatcagccgggaatggtggtgcgggcctgtagtcccagctactcgggaggctgaggcagaagaatctcttgaacctgggaggcagaggttgtggtgagccgagatcatgccactggactccagcctgggcaagaaggatcctctaatctctctccgggaaggtgacgattagggaaagaggaccggaaaatcttactcaatatattgacttaatttatttattttcagtattgtaccctgccccttactgttgctggtatcccccaatctagaaaccctctgtttaaccctctctagagaataaacctaaagtctcaggatggtagagcagcaggcacctgacttcactagttggggagaaaatgtaatgatctgaagcttcggaaacaatttcaaccaatcctccttattttctttagctctctttcacctccactttctgaacattttggggaacgtatgacataaattgtgttgatcgtaagtttaccacagttgggctatgattcagttttcttgggcttgcctagtcatttattgctcttctgtctgctttccaagaaaattgtcttgttgtctacccagactttttaatttcttttttggtctttttgtgggttatgcctttttagtttatttatttatttatttttatttatttttttgagaaggagtctcgctctgtcacccaggctggaatgcaatggcatgatctcagctcattgcagcctctgcctcctgggttcaagtgattctcctgcctcagcctcccaggtagctgggattataggtgcacaccaccacgccccgctaatttttgtgtttttagtagagactgggtttcaccatgttggccaggctggtctcgaactcctgacctcaagcaatcagcctgtctcatcctcccaaagtgctgtgattacaggtgtgagctgccatgcccggcccaacccactgtcttcagacagttttcgccatggtgtccaggctggtctcaaactcctgggctcaagccatcctcttgcctcagcctcccagaatgctgggattacaggtgtgaaccaccacacctggcctagaggtttttttttctttttaaaaaaatttttaaatttcttttttattttttatctttttatttttttgtttatattttttgtgttttcagagattattatactactgtaattgtatatttaggtgtcaatagccacttagctagggacaaatcttatttatctttgaataatcagcatctgtttcactatttggaacacaagttcttgttattttaaaatttaaaacttgtggtaaattaaaatagtttttaaaataaaattttctgtaatccttttatgaatcactgaattaataaccaaaatccattaaaaaataaatgacaaagtgaacaaggcaaattcacttattgtctttgaaaactttttttttttttttttttgagacagagtctcactctgtcacccaggctggagtacaatggtacaatcttggctcactgcaacctctgccttctaggttcaagcagttctctgcctcagcctcccaagtagctgggattacaggcacccgccaccaggcctggctaatttttacatttttagtagagatggggtttcaccatcttgaccaggctggtcttgaactcctgacctcgtgatccacctgccttggcctcccaaagtgctgggattacaggcatgagccactgcacccggcctctttgaaaacatttaagtgaacttactatgacttgagaggcaaggacatgttgtaaaagcttggatacttttatcagtggctatgaaaactaattgctgcctctttattagaattgcatggaaaatacagtgtaatttgagttcaaggagaatatgctaactaaatttggtaaaatctgttgtatttatttagaaaaatatctctgggccggccacagtggctcacgcctgtaatcccagcactttgggaggctgaggcaggtggatcacctgatatcaggagtttgagaccagcctggccaacatggtgaaacgccgtctctactaaaaatacaaaaatcagccaggtgtggtggcatgcatctgtaatcccagctactcggaaggctgaggcaggagaatagcttgaactcgggaggcagaggttgcattgagctgagatcgtgccactgcactccagcctgggtgacagattgagactccgtctcaataaaaagaaaaaaaaaatttctgaatgaaatgcaggctgactttttttgtttttgtttttgtttttgagacaaagtctcattctgttggccaggctggagtacagtggcacttcagcctcaaccttctgggctcaagtgatcctcccacttcagcctcccaagtagctgggaccatgggcatgtgctaccacatccagcttttttttttttggtagagatggggtttcgtcatattgcccaggctggccttgaactcctggactcaagggattctcccacctcagcctcccaaatggctgagattacaggcatgagccaccactcctggcccaggctgactcttaaatacattagctgtaattagctttaccacattttcaggaacataaggcacagtttgggagccttccgcaaaaattttcaagagtctccaaataaaagctgaataatacattatatgtatagtgtatatataggatatatatatgtatttaaaatacatatatatttaaaaatatgtgtgtgtgtgtgtatatatatatatatatatatttttttttttttttttttttttttttttgagagacagtcttactttgtccacagcctggagcgcagtggtgcattcttggctcactgcaacgtccgcttcctgggttcaagctattctccttcctcagcctccccagtagctgggattacaggtgtctgccaccatgcctggctaatttttgtagttttagtagaggcggggtttcaccatgttggccagctgttctcgaactccgaaccttaagtgatctgcccgtcttcatctcccaaagtgctgggattacaggtgtgagccactgcgcctggccacatgatatattttttaaataaaagagaatttggcattgtcaacaattttatataatgaagaaaataatttttatttgagtaggcagactggatctggaaaaaggccttgtttcagaactaagacagcaattatatgagccttccccaaaggtcagcttcttttttagtcctctttctggagaaagaggtcttaacctaattcagggcaggagtttaggaatcccaaacctgtatggaatgaaaattttgtatgagggtacatttttgtcaagaaaaggtccatagctttcatcaaatttccaacagttgagacacttttaagaatcgttggtttatgtacttaactggctgtctttgctgtctagtgaggttataaagtggagggggtgagggagtaaggattagttgtggctttaaggctttttttttttttttgagacagagtcttgctctgctgcccaggctacagtgcagtggggtgatcttggctcactgcaacctccgcctctcgggttcaagcgattctcctgcctcagcctcctgagtagctgggattacaggcacacaccaccacacctggctaatttttgtatgtttagtaaagacgaggtttcaccatgttggcccagctggttttgactcctgatctcaggtgatctgcccatcttggcctcccaaagtgctgggattacaggtgtgagccaccacatctggccgctttaagactttttttgacatacctcataataaaatgtcatttacatcatgacctatatataactgaaacaaaaatttacaaaactatggatactgtcataaactatggtatatcttaacattttctatcttatttcattttcaaaatattggttataacttgctaaattgatttcttaatgttttgctgggtggtaacccataatttgaaaaacactggcctattgcattatagtttacaaaatcctttcatatattcttagttttcacagcagtcccatgaggtacatatgaccttctttaaacttaattaaattcgttaatttatttatttttgagatgggggtcttgctatgttgcccaggctggagtgcattggcttttcacaggtgtggtcatagcacattgcagcctccagctcctggactctagcacacctctgcctcagcctcccaagtagctgggactgtaggtgcacactactgcccagaagactttcttttttatttttacagatgaggaggcttgtctgtatgatatacagagacgttaagtgaccttcaagtctgcagtcacttgcaatatttgacagtcagagtttgagcttgattggtcctaggttttaactccactttcactgcatctttggttacatgatccaaactttttccttcctcttctcagttgtagggaataatactagctcagactgcataactggataaatcctaatattcctaaatgttgtcccttgtcatttaggggtcctctcggaagttttagatttccctaccagtgtaataggttctttccttttgtttcttctctgcccttaacgagtggttctcaagcgtgtatttccatcagtgtcaattaactgtggaacttaaagttgatatccctgggtctccagctgcaattctgattcagcagatctagggtggtgtttagactttgtaaaatttttaaaagctccgcaggtgattcttaaacataatcagagttgagaatttctaccctagatagatttaaattgtcaggcttaagaaggaaaccgaggatttggggagttgctagagactgtttgatcccttacagtttagggacttagtataatgggcactctgtcttccacctggctcccaatctttgtgtgtaggtgtaaccgcttgtaaacataatcagagcttaagtgaattgtagagaatctagtggttctcttctccccactgcctcttttttgatgaaatattagaaatgaaaattttgaaatgtattcatggagtatacaattggaaaagccaccttgtgaaatggtaagcttgttctattgtttaatattttcttaaacaatagtctttatgtaatgtgtttgatttacagaattgaacaaataataaactgctaaactttgtgctttaagttaaataatagatttgaccagtaaaatagatacttcatatattattacctttgtattatgctgagcaaaacaggaattgacaaaagtttgtttcttaaaaaaaaaaaccttaaaatctttctctctttttctctctaggtctttctggaagtggatatctactcagacagtaagaattataagaggtcagttacaaataatactccttgtttacaatgtgataaaaattttgttcatgttgtaaaatatcaaactgtaggcttttgtgttaaaagttgacttccacaaaataatataggcagatttagggtggataacctgaagtgaacaaagagtctaacaatggtactcaactgtattctctctttaattcaggactagaatcagtggaaatgggacaggctgtggagtagcttctagagtgtctggacagctactcagtaattttccatacatgacctctcttttctgttggtttgtaggctcgtgcctgggaaatactattcagtacagttgctggacaggctttttagctgttcacactgagttgcctccaatctatgtaaccgtttagtgaaagctgccttcatggtcttcttagctaggaacttgaagttggccttattgagactctcacttattagcccaggaaccgtgttttattaactctctttttcttctcccatggagtcaaagaattgtgccttgtggattttctcttttgtgtgtggtcatctaacttcagtcagactgcaagctagaatctgcacctgagtgccttgctttcttactttgtgaagaaggcacccattatcttctgttagttgggatgggattttattttttggatctactgttacttttaaacttaactatttactgctgtaaatgtgaaagaaataggctttttgctgctgtaacttttggtgttcttcagtgtggtcagtctgttggaactttcccttccctccccctttctttctttttccctcccttttaccccttttccctcccttttccccttttccctccctctctgccttttttcttcctttttttttttcttttgagacggagggagtctctgtcacccaggctagagtgcagtggcgcaatctcggcacactgcaacctctgcctcctgggttcaagcaattctcatgcctcagcctcccaagtagctgggattacaggtgcccaccgccacgcctggctaattttttgtatttttagtaaagttggggtttcaccatgttggccaggctggtcttgaactcctgatctcaggtgatccgctcaccttggcctcccaaagtgctgggtattacaggcattagcgactgtgcctggccaaaaataatgggagccctttaaaggttttttgtttttttttgttttttgagacagagtctcgctctgtcacctcccaggttcaagcgattctccttacctcagcctcctgagtagctgggattacaggcatgcgccacgctcggctaatttttgtatttttagtagagatggggtttcactgtgttggccaggctggtctcaaactcctgacctcaggtgatctacctgcctcggcctcccaaagtgctgggattacaggcatgagccactgtgcctggcctgtatttttagtagagatggggtttccccatgttgggcaggctgatcttgaactttttttaagacctaatatttcaagggagaaatgtatagtaaatttagacagcaaattttttttgttgcatgatactttttttttttttttttttgagacggagtctcgctctgtcaccaggctggagtgcagtggtgatcttggctcatgttgcatcatacttttatatttgattctagttttgttttattttattttattttattttattttattttatttttgagacggagtctcactctgttgcccaggctggagtgcagtggcgtgatctctgctcactgcaagctccgccccctgggttcacgccatactcctgcctcagcctctcgagtagctgggactacaggtgcccgccactacgcccggctaattttttgtatatttattagagatggggtttcaccatgttagccaggatggtcttgatctcctgaccttgtgatccacctaccttggcctcccaaagtgctgggattacaggcgtgagccactgcgcccagctgattctagttttaaagatagaagttagctaaagtaatctccagttcactttcagaaaatgttaggctgggctcagtggctcacactgataatcccaaccgtttgggaggccaaggtgggaggatcacttgagctcaggagtttgagactaggctgggcaacatgtggagatgctgtctgtacaaaaaaacaaaaagtagccaggcatagtgatgcatgcctgtagtcccagctattttggaggttgaggttggaggatgcttgagcccaggagtttgaggctgcagtgaacgaggatcgtgccactgcactctagcctgagtgacagagcaagaccctgcctctaaaaaaaagggaaatgtctatagttttctttacttttcttttttttttttttttttgagacagggtcctgctctgtcaccaaggctggagtacagtggtgctatcacagcatactgcagtcttgaactcctgggctcaaacgattctcccacctcagcctccccagtagctgggactacaggtgcatgccaccacatgcagctaattaaaaaaaatttttttttagggatgggatctcactatagtgcccaggctggtataggttttctttagttttgttttagcagtcttgccaatttgttaattactgttttattcttgtaccacagtgattctcaacctttagggcttgtgaaagcatagatgaatggatgctggcctgtaggttctgatatggttagttggtctggggaagggcccaagaaatttgcacttctaacaagttcccaggtgatgccaatggtccagggaccacactttgagaaccacactactctagcatttataaatgctgtttgtctctgtaagtgagtaaactgactcacaaattacaccagaacaatcgtgcatatgtaattttcacatgttgagtggtgattcccaaacattttaaagtattgacggtttctcatctgatgtcaaggaacactgttgtccacttactttcatactttacagtgagttatagcatacagagttattaataatacatttattatctattaatgtaccatatcttagagcacttcaaaatcacaattgggaattattatttttctatttttatttttgcagttgcaagatttaatagagtgaagacagagctcccatacaaagggaggggacccaaagagggtagctgtagctggctcgaatgcctgggtttatatcccgatcattgtccctcctgctgtgctgtcaggcaacagatgattggctatttctttatctcctgtttttgcctaattagcattttagtgagctctctttagtatctgattggttgggcgtgagctaagttgcaagcccggtgtttaaaggtggaagcggtcaccttcccagctagtcttagggattcttagttggtctaggaaatctagttattcctgtctctcagtcccccctctcaacaggaaaacccaactgctgttggggaggttggccaacaaccactctaactgcttcctgctgaattggggcgtagtagaggttgtgcagttgagatttcctcgggaggggtgcctttgatgtcattaacatcagagcatgggctagcaggccggtccaggggtccgtggtagattttactcatggactgcatctggggatccatttgaagaacgatttgtagttttactgcttcgattctggaaaagacaaacttaacaaggaggttaaagatacagggtccaaagaggagtaacaatattatagctgctagaggtcctaagaaggggagaatccagggcatccattggctgaggaggccccagggtccagtgttttgcagctcctttgctctacgttatattcgaccttgaatttctttaactttctcggtgatgattccggattgattaacataacaacagcatttttcctctaaaaataaaaaggttcccccgctttccgcggttagcaagtctaaagctcttcgattttgaaggactactgctgctagggagttaagttgatcttgcaaggtgaccagggtatcagcgacccattccatgtcaccatttagttcttgagacagtttgtagtagaactgagtagaggttgtgataccgccaatgccagtagctactccgcctagcactcctgctccaataacaaaaggaagaatgggtactcttttgttgcggggcttaggtatgacatgattgtataaatcttgttcagtgtagatgggcataggggccactaagaatgagaggaagcacacagattctgaagagccattcaaacaatgataggctgaggtaccacagacaaaaaatattcctgagggtaggcagactattcgtgtgggaggagttacccacctgatgcattgggagttggttgtgtctatagtattgctaaattttacacaggtgaggtttgaggtatgggttatttccagattggaaagaggacctactaaaacagaagtggtgtttatttctgtgctgaagttgttccattgttcaggtatagggattgaaatgtgtggcctaaagtgcagggggaggcacatccaacagttagtagggttttgggccgagacctcatggagcccagtcagggtggtattaaataggcttaccaggccagtatgggtatggagggtttcatgtagttttgagagatctagtcctttgtaggggccaggggtgctatgtacccaggtcagttgggagattacttcctttatgtgtttttctgttgcctgatcttgaactccacccccatcagacatactggtatgagtgaagtgagtcctccaagtcctccaggacaactgggattaatcgtttttcctgtccaataatgagtatttgcatgcatgcaaagagtggcagagttatagcagttgtggggcatatgggtgtgggcagtgaaggtgggggttcccttagataaactcctatacaatggggcatcaatatttccgggacgctgcattctccatagaaactcttgctaaggggagctactggcatggacggggcatggacggggtgcagtggcatggacggggtgcagtgagagtgaaagggggtaagagaacagtaaagagaaaaatatgataagggagggccaggggatttacgattttagttactttccccctggttgtcatttgaagagcaggcgcagatcctctagaggttcacaggaatagctagcattgtctcatggatttttgagttcctttggcagtatccagggtttgacttgagtgtgatgtatccaagactccgctccagccactttaactgccgttagggtagataaaatggctgggtagtttccttcccaggatgtatctagggatggggaattagagggaagggacttgactaataccatgtcaccagggtggaatagttcctttccctcttcttggggacaggctccctgtaatgttttaagaacctgttgatatttggctaaggagatgatgtctgcaactaagttggctgtctctcggtcaagcccaagttcattggttaggaagggccgtccatacagcattttgtatggactaagtcctgctttttggggagagtttcggattcttagtaaggctataggcaacagagcaggccatgcgaggtgggtttcctggattagcttttttagatgtcatttgagtgttttgttcattttctccacctttcctgaggactgtggcctccaggcgcagtgtgagtgatattgtatacctaacacctgggatactccttgggttactgtagccttgaaagcagggccattgtcactctgtaagccttggggaagtccgaatctgggaattatttcatgaacgtttattacctcttgggccttttctgtcctacaggggaaggcctctgcccaaccagtgaaagtatctacccaaactagtagatactgaaatccctgagatttgggcctatgggtaaaatctagttgccagtcttctcttgggtagtggcctgttctttgttctcctgaaggagcttggcgataaggcaggggattatttctttggcacacttcacaggccctgactatctgcttgatagttttgaaaaggcctggtccagtaaataatgatttggccatctgatgggtgctatcaatacctaagtgaagggtttggtgaagggttttaagtaatttccattggttagctgcaggcaaaagtatttttccttctttggtggctagccatcctgaggggaggaaactatgtccccgtgaggttccccattctatttcttcttctgagtactggggcttggtttcctggaggggattaccccatactaggtgtccttctataagcatttctaatggagggtcctgccttgcggctcttttggctccaatatctggttggcggttcccttctatttccctttcctttcctttcctttctgatgacaccggcagtgtaagactgccacctctttaggtttctgtacagcctagaataatctcctgatggcttcccgatgtttgataggtgttccttggaagttaggaattccctttctctccatattgctgcatgggcatggaggactaggtaagcatacttagagtctgtatatatatttatcctttttccttctcctaattctagtgcctgagtgagggctatgagttctgccagctgagcagtagttgctggagtgagggcattactttcaagtattccattatcactgaccactgcataccccacttttcaaagtcctttttctacaaaggaacttccatcagtatacaagttgaggtcgggatcagtcaagggaacctctaaaaggtccacaattgggaattattaatctttttttttttttttttttctagacagagtctcactctgtcacccaggctggagtgcagaggcatgatctcagctcactgcaacctccgcctcccgggttcaagtgattcttctgcctcagcctcccgagtagctgggattatacacttgttaccacacccagctaatttttgtatttttagtagagacggggtttcaccatgttggccaggttggtgttgaactgctgacctcaggtgatctacccacctcggcctaccaaagtgctggtatttacaggcgtgagccaccgcgtccggccaatctttttttttttttttttgtacagatgggatcttgttttgatgctcatgctagtcttgaactcctggactcaaacaatcctcctgcctctgcctcccaagttgttaggattataggcgtgagccaccgcgcccaggcttattttctgaattaaaataattgatctgggtacaagctatttaatactgagttgatctgtagttttgaaattttaaaataggatttttgagatgacagaagaaatattgtttcatttagtttgggtttttattgttgtgggctcttattttggtttttaaaaaatatttttaaatttttatgggcagcacttcattccataaaagagaatgaatgttgctgttttggtctttattaattagtttctttttctttcttttttttttttaaattatacttttaagttctgggatacatgtgcagaacatgcaggtttgttatgtaggtaaacacgtgtcatgatggtttgctgttaattagtttcttagttagctattggcagtatctaatcctaactggtaaggccctacatttagaaaaattatacttacttgaggtgattatagattttaaatttggtgatagattcattttcttctcatatcagtgtcagcacattagagccaaaagtagtcattttggggtgacattttaaaatgcataatttaagaaaaaactcatgaggacaagtaaagtttttttttttttaattaaaaattacctatctggagtttgttttaaaagtatacacatacgtaaaattcataggccaggcacagtggcttacacctgtaatcccagcagtttgggagcctaaggtgagaggattgcttgagcccaggagttcaagaccagcctaggcaacatagggagtccccatttctacaaaatatttaaaaattagaccgggcacagtggctcacacccatagtcctagcactttgagaggctgaggtgggtggatcatgagatcaggagttcaagaccagcctagccaagatagtgaaactccatctctactaaaaatacaaaagtcagccgggcatggtggtgggtacctgtaatcccagctacttgggaggccgaggcagagaattgcttgaacccgggaggcggaggttgcagtgagctgagatcgtgccattgcactccagcctgggcgacagagtgagactacgtctcaaaaaagaaaaaaaaaataggccgggtgcggtggctcacacctggaatcccagcactttgggaggctgaggcggaaggtcaggagatcgagaccatcctggctaacacggtgaaaccccatctctactaaaaatacaaaaaattagctgggtgttgtggcgggtgcctgtagtcccaggtactcaggaggctgaggcaggagaatgacatgaacccgggaggcggagcttgcagtgagtggcagtcgcaccactgcactccagcctgggcaacagagcgagactccgtctctaaataaataaataaataaataaataaataaataaataaatgaaaaataaaaatagaattagccgggcatggtggcacgtgcctatagtcccagctactggggaggctgaggtaggaggatcacttgagcccaaagagtttgaggctgcagtgaaccatgattgtagtactgcatgctgtatgggtgacagagtgagaccctgtctcaaataaataaataataaaataaaagttatagcctctcaatatatagtgtttgaagccagatgagcattatgtagtttaaatattatttcaaacaaccattactctatccagacccttaccatttattcccccattactaacaaccaaaatatcaatatcacaacaagcagctttttcctactgcaaaggtttccccattgatcataattatttcctggacaccaccaaatgaaaatgagattaggaatgccttataggcttttgagaaaaatttctttgaggaaaagggaactggttttaatttatgggcatagttatcatgatctcaattttcctcccttgtagaaattaaaggccctgaaatagaatagccaaggaagttagttctcaaattgccttgcttccacgtctcagctatggtttattagatataacctctggctgacctcagatatagattattattcataacctgcctttctcacttttcattttctccatagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtaagagagagttcaatggtctacttatttaatctgtcttgttagttttgctgattatgttctgaaaagagcaaggatgatttcagctaagactgctttgccttttcctatgtcactgaactcaaagctttgttgaggaagtcagaaatgatgtatttttcagaaatcatgtatgttcccatcaaatttttcatgtcctactaggttttttttgtttttgtttttgttttttgagacggagtcttgctttgttgcccaagctggagtgcagtggtgcggtctcagctcactgcaacctccgcctcctgggttcaagcaattcttctgcctcagcctcccaagtagctgggattacaggcgcctgccaccatgcccagctaattttttgtgtttttagtagagatggagtttcaccatgttggccaggctggtcttgaactcctgaccttgtgatccgcccacctcagctttccaaaatgctgggattagaggtgtgagctaccccgcccagcctattttttttttttttttttgagatagagtctcactctgtcgcccaaatgggagtgcagtggtacaatctcagctcactgcaacctctgcctcccaggttcaagagattctcctgcctcagcctcctgaatagctgggactacaagtgcatgcccttgcgcctagctgatttctgttgtttttgatagacaccgggtttcgccatgttggccaggctggtctcgaattcctgacctcaagtgatccgcctgcctcagtctctcaaagtgctgggattaaagatatgaaccactacacctggccacttctacctgctaggtctttcagtgagacctagtgagtaagagttaggttgaggaacatcagtttttgtactactttgactaacattgttctaactatcttgatgattgataggacttctccaggtgttgtcaacttcgtagtaagtttttttgaactaattcatcagattgtcaggaagttatattctgtttctagcagggccagtccccaataaagggctgttaatagagctctcctttttctctagaaacacagttctccctaactgagaatgtcagtacatagtaacactagattgtttttatttatcgatgtttgattatataactagcgtgtgagatactaacctttggtcatttacttttcagttcttggattaaaaggtctggatcagtggttcttggttctcactgttcatcagaatcacctcggggagccttgggagataagccccatccccagagatttcgattcatttgatactggcttggtgtggaactggggcttttttttaaggtatccaggtgattgttgtgtacagccagcattcagattataggtgtaccctagataacataagttagggtggctgttgttgctgttactatcttggcacctttattattaatgggtcataaaataattcagctctattttatacactaaatatatcaactctataataaaatcctgtatgagatctggctggatgtgattgttctgtcttactgttatccctggggcttgggatcggggcttctgagagactaggcagtgttcgttagtggtcaccctcatttagctatgtagaggtcaaaagaaaagtgtaaagcaagttaattatgttttacttcacaggttcctagaattgtaataaaccagagagataatttagcctaacactttttattttattttattttaaaaaattaatttaaaacattatttaaatagagacagaggtcttgctatgttgcccaggctggtcttgaactcctggcctcaagcgatcctcctatcatggcctgccaaagtgctgggattacaggcatgagccaccacacctggccacaaaatactttttgatagttgggaaaactaaggcccaatgaggagaaataacttgcctaagtttgaatagccagagaacttggattcaaactcatatcctgattttatttcactaacttttctactctactttcccgtccatacaggtgtcttaattatataactagttcagacaaagttggttttatggagttagtgaacaaagcattatctctgggttaaaaagaggaatagagagcagtattttagtggcagggaaaagggattaggtctttatgtaaacattttttattttatagttcacttaatgattggctctaaggttaatactagtggtggcattcttctctcttgaggtcatttggaagtgtgttggggggttgtgactggcaggactacttgcatttatcggacaaaggacaaaggaccaatgatactaaaccttctgtggtatagtagataatcctacacaaccaagaaatctgctactcaaaatgtcgtagtgcccctgttgagaaagactggtttaactctaaatccataaaaccacacagcaccttgagaaatctgtccagtttgagtctatgtgaaacataatatccatttgctggattaggaaactgagtttggctatggtgagataaatgtgttataagaaactcagctagtgatatcacaaggcagtttgtagttgccaagtcattcccaaagttgatggttcttatgcaaagtctatgtggtcagtggcatgagtgtctggaatttctttgcatgccttactgttgcaaaaatcatgtccgtagctcgtggaggagccatggattgaagtgtgatcagcagcatggaaaggagacaatgccagttccaactcactcctcagctagctaatgttctaaaatagaaaaaacgttttctgtttatccattccttaagtcacttctggatatggtgacctttggggtaattttaattgagtcaaattcatttgataggtgaaagacctctgttatgacatctgccactaattaggtgtgtgaccatggacagtacatattatctccttggagtcatctataaaaatgaagatattgattcagatgctccttttcactcctggaactcaaagttaaatagagactaagttgagtttaggatcagctcttagaacgaatagcctaatccttcatgggtgacatagattaagggggcaggtacattcctaggagatgttaactggaggtcatctgaaaccaaatgaagtaattgccataatgtaagatgggactgagtctctctctcaagtttaggtgctgagaagtctagtggtatgatggatgagcccaaatagaaaatagacttttcctgcgatggagatgatttgccccatgtattttctagagtccaatgaaagactgggtgaatcactttcttttttctttctttcttttttttttttagagggagactcgctctgtcgcccaggctggagtgcagtggtaccatctcggctcactgcaaccttcacttcccaggttcaagcaattctcctgcctcagcctcccaagtagctgagattacaggcacccgctaccatgcccggctgttttgtatttttagtagagacagggtttcaccgtgttggccagactggtctcgaactcctgacctcaggtgatctgcccgcctcagcctcccaaattgctgggattacaggcgtgagccagcatgcccagccttttttttttttcttttgagacggagtttcgctcttgttacccaggctggagtgtaatggtgcaatctccacttaccgcaacctctgcctcccgggttcaagagattctcctgcctcagcctcctgagtagctgggattacaggcatacgccaccacgccaggctgattttgtgtttttagtagagacagggtttctccatgttaggctagactcgaactcccaacctcaggtgatccacctgccttggcctcccaaagtgctgagattacaggcatgagcctgtaatctgtgcctgtcagcctatgcctgaccctggccatttttttttttttttttttttgagacagtcttgctctttcacccaggctgaattacagtggtgcaatctcagcccactgcaacctccgcctcccaggttcaagatattcttgtgcctcagcctcctgagcagctagtactggaggtgtgtgccaccatgcccggctaatttttttgtattttagtagagatggggtttcaccatattggccaggctggtcttgaactcctgatctcaggcaatccgcctgcctcagccttccaaagtgctaggattacaggtgtgagccaccatgcccagctggatgaatcactttctaagctttatgacccaaacatttgaaaataagaccctggctgggcgtggtggctcacgcctgcaatcccagcactttaggaagccaaggtgggtggatcacctgaagtcagcagttcaagaccagcctgaccaacatggagaaaccccatctctactaaaaatacaaaattagccgagcacgatggcacatgcctgtagttccagccagtcgagaggctgaggcaggagaagtgcttgaatccgggggtgcagaggttgcggtgagccgagatcatgccattgcactcccgcctgggcaacagagcaaaaaaaaaaaaaaaaaaaaaaaaaaagaaagaaaagaaaataagaccctaagtaaaaagtagttatagcttggtgggaatatacagacctcattgtagacaactgatttggctttttatttttagatatgatcagctagaggttgatatatcagccaggttgatatatttctggaactcactagtattcaattgaacatttaagaagaaaggctgaatgtggactttttttttttttttgagactgagtttcactcttgttgtacaggctggagtgcaatggcgcgatcttggctcactgcaacctctgcttcctggtttcaagcaattctcctcccttagcctcccaagtagctgcgattacaggtgctctccaccatgccgcactaatttttttttttttttttgagagggagtctcgctctgtccccaggctagagtgcagtggcgccatcttggctcactgcaacctccgcctcctgggttcaagcgattctcctgcctcagccccctgagtagctgggattagaggtgcgcgccaccatgcccggctaatttttgtatttttagcagagacagggtttcaccgtgttcgtcaggcaggtctcgaactcctgaccttgtgatctgcctgcctcagcctcccaaagtgctgggttacaggtgtgagccactgtgcccagcccaccatgcctggctaattttttgtattttattttattttacttatttattcatttatttttttaatttaattttttttttttttttgagttggagtttcactgttgttccccaggctggagtgcaatggtgccatctcggctcaccacaacctccgcctcccgggttcaagcaattctcctgcctcagcctctcgagtagctgggactacaggtatgcgccaccatgcctggcaaatttttttttttttttgagatggagtttcactcttgttgcccaggctggagtgcagtggcatgatctcagctcactgcaacctctgcctcccgggttcaagtgattctcctgcctcagcctcccaagtagctgggattacaggcgtgtgccaccatgcctggctaattttgtattttttagtagagatggggtttctccatgttggtcaggctggtctcaaactcccgacctcacgtgatccgcccgcctcagcctcccaaagtgctgggagtatgggtgggcgtgagccaccacacctggcttatttattaatttttttgagacagagtttcgctcttgttgcccaggccagagtgcagtggcgcaatctcggctcactgcaacttccgcctcccaggttcatgtgattctcctgcctcagcctccccagtagctgggactacaggcatgcgccaccacgtctggctaattttgtatttgtagtagagatggggtttctccatgtaggtcaggctggtcttgaattcccgacctcaggtgatctgcccacctcggcctcccaaagtgctgagattacaggtgtgagccactgtgcccagctaattttttgcatttttagtagagatggggtttcaccatgttggccaggctggtcttgaacccctgacctcaggtgatccacccgccttggcctcccaaagtgctgggattacaggcgcccggccagtggacatcttaattttgataaccagtgtatgatttggtggcatataacagagccatctagttgtatggatattggcagtttctctgctcctatgggatgtcacttgaggtcagatcgttttgcatacttaaaattcaccgcatgctatcaaccaaatagaactgtaaacagtttgtcaactaataagctgaatttctggttgaagtacagttggaacaggttatctccacatttgggtcttttacctcttagcatagtgtgatttctttcctcttttttaaaaatccacctccttcctctctagcatagtgtgatttctttaaatcttttttatcctatgctaaatgtatgggttttttgtttgtttgtttggtctcactctgtcacccaggctgaagtgttcagtggcgcaatcatagctcactaacttccaactcctgggctcaaacaatcctcctgcttcagcctcctgagtagtggagattataggtgtgcaccaccgtgctgagctaatttttaaaatttttttagagatggggtcttgctatgttgccctggttggtcttgaattcctggcctcaagtgattgtctggccttggccttcccaagtgctgggatgacaggtgtgagctaccttgcccagtgtatacttcatgttatagtgaaacaggagagttccctcatctcccttgcaggatgtaccacagggatgtgtcttgcttgctccttcggttgccccactgctcaaacccctaaggggaggatgcagatgggcaggtgcaacagccatgggaagcacttttgggctccagccccacggcaccatcttggggtggtgtctgcgactctgaaagcccaagtgagcatgtgttacagtgtgctctttcagctttgctgtctgcagacagcttgtgttaaccagctcaatagaccatctgccttattgcaagggcagagggccagtgtgacagctttctgtatcctgagctcttgcccagtgtaccagaaaaattggatcacatgtgggctcgaaggatgagtgcaaggttttattgagtggtggaagtggctctcagcgacatggatggggagctggaaggaggggctggagtagggaggtggtcttccccaggaatcagggctcctggaggccggactcttctctgacggccccgagttgaattcccctcggtgtccagacgtccctcctctctttctctgccttgtcgttccaccattgcaagtctgctggcctgctggtgtctgctggtctgttcctctgctcctcttgatgttcaatcacttgtgtctgtgcctgctgtggtctcgggtttatttgggcacaggattgggggtgttgcaggccagagtggtcttggaaaatgaagcatttggatgcaaaaacaggcatgcctgttctcacttaggtccataggtacaggtcaaaggtggagcccttgacagggactctgcccttctctacccagcacttccctgtccccttcccatatcaatagtatttgaaacttgatctcaattttctctcatgtgtcttaaaacatatgttcaagtcactgaatgatcttcattttatggttaacataaaatgaagcatgtttggttaacaactttatctgagaacaatctgtatttgctgttatatgtgtatacctaaaaccagcgtaagatgtctatcactggggttcaagacaatagttgttgctttggaaggagaaagtatattcactcaggaagggctctgaagttgagttatatttctatttcttttctgatctagaaagaaaagtactttaccaatatttttgaaaattgagaattcagatgagattgcctgtaaagatgttggactcttcagaataatttaactagaaaattttgagctcttttgtaattataaataatttgtaaagtttctcccatgatactagtcatagtatgttaatgagtttggaataagctcctagataccacatttcatttttttttttttttttgagatggagtcttgctctgtcgcccaggctgggtgcagtggcacgatctcggcttactgcaacctccgcctcctgggttcaagtgattctcctgcctcagcctcctgagtagctgggataacaggtgtgcaccaccatgcccggctaatttttgtatttgtatttttttttaattatttatttatttatttttttgagatggagtctcgctctgtcgcccaggctggagggcagtggcgcaatctcggctcactgcaagctccgcctcctgggttcacgccattctcctgcctcaccctccccagcagctgggactacaggcacatgccgccacgcctggctaatttttgtatttttagtagagacggggtttctctgtgttagccaggatggtatcgatctcctgacctcatgatccgcccgcctcagcctcccaaagtgctgagattacagacgtgagccaccgcacccggccacgttttgtagttttagtagagacaccatgttggtcaggctggtcttgaactcctgacctcgtgatccacctgccttggcctcccaaagtgctgggattacaggtgtgagccaccacgcccagccagatttcattttcattcacaattcatataaagctgtgcagacctttatccttgggcagtaatagtgtcaaggtcagattctgggaggatctgggattgactttcaacttcttccattgggtcaaaagagaagtttagaggacaatagtgagagaaggcctatctattgttcctacattctatttttcacattaactttaggaaatattagtcaagttttctcagtggctaattagaaaaataatggtaataataggttacatttaataagtgctttactgtatgccggatactctgctgtgctttatgtggagtaccacactgaattatcaaaacaatcccatgaggtaagtattgtgctattatttcccacaatttttttttttcttttttttttgagatggagtctcactctgttgcccaggctggagtgtgatggcgtgatctcggctcactgcaacctctgcctcccaggttcaagcaatcctctagcctcagcctcccaagtagctgggattacaggtgcccgccatcatgcctggctaattttcatatttttagtagagacagggtttcaccatattgctcaggctggtctcgaacccctgacctcaggtgatccacctgcctcggcttcccaaagtgctgggattacaggcaggagccaccgtgcctggcctattgcccacaatttatggatggggaattgagacataaattaaataacatgcccaaggtggccagcttgggtattgaatctagtcagagctcgtactataaactactacactaaactaaaacctttggtgtaacagatatgcttttttttttttgagatgaagtctcgctctgtcgcccaggctggaatacagtggtgtgatctcggctcactgcaacctctgcctcccaggttcaagctattttcctgcctcaggctcccatgtagctgggacaacaggtgtgcgccaccatgcctggctaatttttgtttttttagtagagacagggtttcgccatgttggccagctggtctcgaactcctgacctcaggtgatctacccacctcagcctcccaaagtgctaggattacaggcgtgagccactgcgcccaggccttatggtctgttgagcagttcttctctaattaaatgttagccttgttagaaagggatagaagttagaaaatatatatttatatatacttgaaaaattttttttacagacagggtttctctctgttgtccaggctggagtgcagtggtgtgatcatggctcactgtaccttcagactcctgggctcaagcaatcctcttgctcagtccctgagtagttgggactacaggtatgtgccaccattcccagctaagtttatttatttatttatttattttttgagatggagtctcactctgttgccaaggctggagtgcagtggcatgatcttggctcactgcaatctctgcctcccaagttcaagcaattctctgcctcagcctcctgagtagctgggattacaggggcctgccaccacccccagctaattttttgtatttttagtagagacagggtttcaccatcttggccaggctggttttgaactcctgacatcgtgatccacccaccttggcctcccaaaatgctgggattacaggcgtgagccacagcgcctggcctaaatttttttgtagagatggggtctcaccacgttgcccagggtggtcttgaactcctgggctcaagtggtcctcccactttgacctgtcaaagtgctgggattacaggtgtgagctaccgtgcccagcctagaaaaaatattttttaaatcatgctttattaaagaagcagaatagaaaataaaaaacaacacaagcaagcaaacataaacgcttgtatatttgccacccaaaggttactccctaccatctgtatccttttctatgcatatatgtatatattcatatttttttactaaaatgaggtcatactgtacacactgttttataatctgctttttttagtcaaaaaaattcactttctatttcaataaattttaatctaatttaatatacacactctattcatttctccaaggaacctgaaaattctggttccttcatgcaagtatccaatccacaaattgtgtattatgttctttaaatttcttaatctgtcacattctatcacattaccaccccccacctttttttatgacagtgactagtgactcgtttaagaggaagttagcaaatcatgaaagtatatgattgctagtgaaaatttggtagcatatagagaaacagaaggaaaaataaaggaagatttaccattctacactttttatagttacagagcaacaattggtattaattgcattaatgatgatattttaatgaattttataatcattttatgtaccatttatgacagagctttttagttttagctatatatgtttgtgtttgactaggaaagacatacagattctcatttctttttagtctcactttaaactccttgagtttgaaatgactttatttaaatctagtggtagagatagagttaagtaatagctatgaaacttttggaatagtaaaatgtgccatattggtataatacattatttattatcaaggagtccttttataagataaaaattttttactggaaaaacctctttaagtcttttgcatgttagtgcttaaaacttggaaatttaggtctgaaagccttttgatgatggcaaatatatactatcaatattataattcaaacgttgagaataaccactattgaaaatgcaggaggccaggcgcggtggctcacgcctgtaatcccagcactttgggaggccaaggcaggtggatctcctgaggtgaggagttcaaaaccagcctggccaacatggcgaaaccttgtctctactaaaaatacaaacattagccaggtggtggcgagcacctgtaatcccaactacttgggaggctgaagcataagaattgcttgaacccgggaggtggaggttgcagtgagctgacagcacgccactgcactgcactccagcctgagcaacagagcaagactccatctcaaaaacagaaaaaaagaaaagaaagtgcaggaaattttattcctgcttcctatctattggttcatcactatcaagctttgacatgggaaataaggaaattggctctggttttgtttatattaaggctttgcttatggatagtttgagagtgttcttatgtattgactttcttagcatttttcatttagctttcctgagcttcttcccttcccctaatagctctccaaactttctactttcagtgctccttccttgatattctgaggttcccagttgccatggtgcctttgtagtgagtagacagagaaggtcattatgagatctgcaacttggtactcctttgctgagggaactagtttcctctttccatctcccatcctccccttctttccattcagaaaacaggagctgtctgtggccatatatgtattttagtctctggagtgcattctataaacttagctaattgtggaaatgaaattatgaatgttgtaagtaaggctcggtacagctgcttgacagtgtttattacttttattatttcaagtgtaatgcatgcatttccccctcttttctttctgttagcataaatttacaaatgaagtttgcatttactactttatattgttaaattattagaagtaatgtaggtttattattagaaaagtaggaaatccaagaagtttttttttccagatagagtcttgctgtgtcgcccaggctggagtacagtggcatgatcttggctcactgcctccgcctcccgggttcaagcgattctcgtgcctcagcctactaagtagctgagattacaggtgcccgccactattcccagctaatttttgtatttttagtagagacggggtttcgccctgttgcctaggcagggccgcctgccttggcctcccaaagtgctgggattacaggcgtcagccaccgcgcccagcctcaaaaagtatttaaaaaaatagaaacactgaggaatacaatcattccatagtaatcactattcatattttatatatttcctttctgtattttttaccacttaaggataaatgtcattaaaaatatacatatagatgatattataatgaatatacagctctgctttctgctttttttccccatataacaacactttctcatgtcattgcaaatctttttttcttttttttttttttctgtgacagggtctctgtcacccaggctggagtacagtggcatgatcacggctcactgcagcttcaacctccctgggctcaagtgatcctcccacgtcagcctcccaagtagatgggactacagacgtacaccaccacacccagctaatttttgtattttttgtagagacacggtttcgccatgttggccaggctggtctcgaactctggaccttaggtgatctaccctcctcggcctcccaaagtgctgggattacagacatgagctacctcgcctggcctgattctaaattttggctgttgtgaatagtgctgcagtaaatatggagtgcagatatctctttgatatgttgatttcctttcttttggatatatacccagtagtggaattgctgggttatatggaagctctatttttagttttttgaagaggtttcatactgctttccgtagtggcagtactaatttatattcctaccaacagtgtacgaggtttcccctttctccacatcttcatctcatgacactacttcagagggttcttgttacccataggatatgttagtgtctagccaaacattgtgtcacaggtgcttaacattatttctaatactcacaacagtactaattattattatggtgggctcaatgagttctgttaagggtccaataaggtcttggagatgtttgaactagaatttgaaggatgaacagaaaaaaggctagcaaagttaggggtgtgtgtgtgtgtgtgtgtgtgtgtgtgtgtgtgtgtgtgtatgtaagggtagagctggtagggtagacaatgtgcagaagtatcagtgaaacgtctagcattttcaggcaattacaagtcattgactattactgcaatggaaggtgggcagcatggttggtgcaaaagaagaggccggtaagacagaggtcaggtcattaagggtctttcatgtcatactgtgataataaataagcatttggtctctatccttggttcctggcacacagttcctaaagcccttgggatttcttgaccggtaagtatcttttatgataatgagatgactggggtctgagggcccctggatagcttcaggctggggtctgttaaccagaaagaccaaggaataattagagaattggaactttcaagtctgctctctaacctccagggaggggcaaggggctgaaaattgagctaatcacaagtggccagagatttaatcagccatgcctacttaatgaaacctccataaaaccttgtaaacaacagagttcatagagcttctgggatggtcaacacatagaggttctggtagagctgtatgcctggaggaaggtttggaagttctgtgccccttcccccataccttgccctatatgtctcttcctgagttcctgagttgtatcctttataaagcagtaatagtaagtaaactcttttcctgtgttctgtatgtcattctagcaaattatcaaacacgaggaaggggtcatgggaatctccgatttatagctggttggtcaggagtataggtggctgggatttgcaactggtatctgaagtaggggacagtcttgtgggactgagccattaacctgtaggatctgtgctaactctgggtaattaatataagaattcaattgtgagactcccagttggtagctggacagaactggttgttgatatggaaaaaaacctgtacattcggtgtcaaagtgttgtaagtaaatacagctcagacataagacatctgtaaaatggaaaacaatgtttaggttctccttaactgtgcaacagactttattaaaaatatggattccagctgggtacggtggctcacgcctgtaatcccagcactttgggaggcagaggcgggtggatcacctaaggtggggagttcgagaccagcctgaccaacatggagaaaccccatctctactaaaaatacaaaattagttgggcgtggtggcacattcttgtaatcccagctactcgggaggctgaggcaggagaatggcttgaacccgggaggtggaggttgtggtgagccaagattgtgccattgcactccagcctgggcaacaagagcgaaactccatctcaaaaaaaaaaaaaaaaaaaaaaaagcattcctggccgggtgcggtagctcatgcctgtaaattcctagcactttgggaggctgaggcagacaaatcacttgaggtcaggagtttgagaacagcctggccaacacagtgaaaccacgtctctactaaagatacaaaacttacccgggcatggggacatgtacctgtagtcccagctacttgggaggctgaggcaggagaatcacttgaacccagaaggcggaggttgctgtgagccaagattgtgccactgtacttccagcctggttgacagagtgagataccatctcaaaaaaaaaaaaaaaaaaaaaaagtgtggattcctgagtcctatcccggatttattagattacagcctctggtcgtggagcccaggaatcgttattctaatactttccaggagagtctggtatgaatcctgagccaagaagcactttttcagagcttagaacaatgcttggcacatttcagtgcttaataaatgtttgttacattgaaattaaagttgtacaaatggaaatctacttgcacaagaatatatagtagagtggtcgggcgcagtggctcatgcctgtaatcccagcactttgggaggctgaggcgggcggatcacgaggtcaggagatcgagaccatcctggctaacacggtgaaacctcatctctactaaaaatacaaaaaattagccgtgcatggtggcgggcacctgtagtcccagctactcgggaggctgaggcagaatagtgtgaacccgtgaggcagagcttgcagtgagccaagatttcgccactgcactccagcctgggtgacagagtgagactccatctcaaaaaaaaaaaaaaaaaagaatatatagtagaaaggaaatatgtcttagggaaatatctacctcattcttttttatggctcaatagtactccattgtgtgtatggagtagatatactctctattttattacatatttctttttatccattcatctgttgatggacccttacgttgattccaaatcttggccattgtgaatagtgctgtaataaacatgggagtgtagatatctcttcaatatactgatttcctttattttttgcatttacctagctgtgggattgctgggttgtatggcagttccatttttagttttttgaggaacctccatactgttctccatagtggttgtatggagatttacattcccattgtgttttaatttatacagccatcaagggaaccaccaatacaagggttcccttttctccacatcctcttagcatttgttactgcctcttttgggtaaaagccattttaactggagtgagattatatctcattgtagttttgatttgcttttctctgatgatcagtgatgttaagcgccttttcatatagctgtttgctaattgtatgtctgcttttgagaaatgtgtattcagaacttttgcctattttaaaattggattattagatattttcctattgagttgtttgagctccttatatattctggctatcaatcctctgtcagatggagatactgtttgttgaaatgaaaatgaagttgtaataaccatagtttgatatctcatatttttctgagtattctttctcccaagattcatagttctttagttctttttttttttcccttcaacttctattttaagttatggggtacacctgcaggatgtgcaggaggtaaatgtatgcaatggtggtttgctgcacagatgaacccatcaccttggtattaagcccagtatccattagctattcttcctgatgctctccctcctgcaaccccccaaaattcttatctcaaaatgctaaatttaataattcttcataagtaaaaattctaacctcctccctagtaaaatctaatgatagtcatgaaactgggactccattagtcaggaaaatgtctaggagttcatcaaggaaagattcttcagagtgttcagaatattgaatttgggttccaggatatcctgatctgccaaatgtatcatgacccactaattgtgtcatgtcatctctatattttttccctttatatattttttttgtttctttaaaaattttttttgtagagatggggtcttgctacgttgtccaggctggtttcaaactcctggactcaagtgattcttctgccttggcctttcgaaatgctgacattacaggtgtgagccaccgggcccagctgcctttattatttcagttcccaccatcactgactttatgtaggtgttcattatctctagcctagtctattacaatggcctttaactattttctcttactttagtctctccctgtttcacatctgttcaaaaacatgtaatgttttccctctgctttcagagtaaagcccaagataacaaccccaacttttactgccatttattgagcatttactgtgagttaagcactaagtgctttcaatatttatcttatgtaaccaaacaacagtcagtcctgtaaaataggcgttaattatctccattttccagaagaggaggatacaggctcagagagattatgtaattttcctacctaataagtggtggaggcattcagtcatggtattcagattcttccacaattaggccatagctgatttttccagtcttgtttctacccagtgttttttccctctttgcttattccagttgcagtagacaattgcctgtttcctaaaattccatatactttccatctttatgtcctttgatcattctatttgtgtctcagtctcttttcctgtgtctctctttgtcatgtatccttactgaaatgccatttccctgactgttgaaattccatttacccttggaggtcatcactcctttttttctttttaatgagatgaagtcttgctgtgttgtccaggctggtctcaaactcctggcctcaagtgatctcctcacctcagtttcccaaatgctaggattacaagtgtgagtcaccatgcccatctgaggtcatcaatctttaaagaccttctgaaatgctgcctctgctatgaagcttttcttttttctcttctccttcttcttcttctttttttttttttttgagacagggtcttgctctgtcacccatgctggagtgcagtggcatgatcttggctcactgcaaactccacctcctggattcaagcaattctcctgcctcagcctcccgagtagctgggattacaggtgcgcgccaccatgcccaactaatatgaagcttttcttgttctttctcctatattgtttttctcttctggtaatttggccttccattttctgcaacagtaatttcatttcttctccattgtccttaaaccagcagttccatttgtgccatttcctgcctcttctagacacttttaatttatagctttgccacattattttattaagaaaatagagactatctagtaattcttctaacacctcatttcaaacttacttttatctgtattctccttctcattttttcttcatgcatatgtatgtatgtgtgtgtgtgtatttgtgtgtgtgtgtgttttgtaacccagaacaatgctgacaacatttttccttctttcctgagaagtgttccaagtgcttggaacagaggatgaccaaaggagggagggtcctgagaagtgttccaagcactctgatttcttccatctttatagaaggcctttttttgatagccacattccctttggattattgccttatctctctgccccattttatggtcaagattttcagaagtgctatccctacttcctcatctcccattcattcttaaagctattctgttctgtcctctgcccaactatgctattgaaactgctctcgtaaaaaccactaatgactactgtattgctaaatcagtggatgcttttcagttctcatccttctaagtctctcaacagttccatacaagtgactacttttttcttgaaacacatgccttcttttctgctaaagactacactttcatgactcctgtgttacctccattctactcttaccaatctccagtctcccttgcaagtccttctgctttcatgcaacctttgagtgttgaatactttcattgcttggttctggtccttcttatctttttacttgatatacattttctttctttttttttttttttttttttgagatggtgtctcgctctgttgcccagggtagagtgcaatgttgcaatcttggctctctgcaacctctgcctctgggttcaagtgattctcctgcttcagtctcccaggtagctgggattacaggcgcccaccatcatgcctggctaattttttgtatttttagtagagacagggtttcaccatgttggccaggctggtcttggactcctgacctcaggtgatccacctgcctctgcctcccaaagtgctgggattacaggtgtgagccactgtacccagccacattttctatatataaaattcatccctttgctactgcttatatgctgatgattcccaaatttataatatccatcccagacctatcctctgagatcacttgttatgttcacctattcatatgacattttcatttgaatgtcttatagacattaaattcttgatttcccctatcttcttcataaatttgatcctcccccaatcttccacatctcactaaatagcacctccagccactctgctcaaaccaaaaaacctgggaattgtacttcagtttggttgattctatctccggtattgaccccagtaccttcacttgcaatcaccttagtccaagccttagcacgtcagctcttgcttggactattagaatgatcacctaactagatttcctgtctgtattatacttttgcctccttatttcttgctgcacatagcataagatacaaaattctagtttttctgtttttttgttttgaaacagggtcttgctctgtcacccaggctggagtagtgcaaacaggactcactgcagcctcaagcttctgggctcaagcctcagactcccaagtacctgggtcaataggtgcatgccaccctgcttggataatttttaaatttttttgtagagatgtgttctcactatgtggcccaggctggtctcaaagtctcggactcaagtgatcctctcgccttcacctctcaaagtgctgggattacaggtgtaagccaccacacctggcctagatacaaaatttttaactcagctcatgagaccctgaatgatctgacttctgtcaacttccatttgctgacagggcttcaatcatactggcctttcagttcccctgaaaagatagtagtccaatatttttcctatctcaaggccacatgcactggtccttatgcctagaattcactttcactctctttgatcacttgaggtctttatcctttaggtttcagatcaaatatcatttccccaaagaggctctattgttacagtgttcctttttttcccattgcaatagcatttatcacaatttgtaatgtttttagtaatatatttatttgatttcttgtctccattatactgtaacatgagcacagaagccatatattttgtttatagctgtatactcatcattttctatagcatataatagtcactcaataaatacttgttgaagccaggcatcgtggctcatgcctgtaatcccagcgctttgggagactaaagcaggaggtttgcttgagcccaggaatttgggacaagcctaggcaacatagagagacctatactctacaaaaaaaaattttttttaatagctgggcatggtgttgcatgcctgtattcctagctactcggaaggctgaggcgagaggactgtttgagcccccaagagtttaaggccgcagtgaactatgatcatgctactgtactccagcctaggcaacagagcaagactgtctctacaaagtaaataaaaacataaaataaatacttgtgaataaatggtagaggtataaagactgattgggaacagtcacaaaagataatagtagtagtttttgtttttccattttcatttttattttattttatttgagggcagtagcgcaatcttggctcactgcaacctccgcctctcaggttcaagcagttcttgtgcctcagtctcccgagtagctaggattacaggcgtgcaccactaagccagctaatttttgtatttttagtagaggcagtgtttcaccatattacccaggctgatctcaaactcctgacctcaaatgatccacctgccttggccttccaacgtgctgggattacaggcgtgagtcaccacacctggctagtagtttttaaattatacatattatgtatttgatttctgtagtagatttaggattattcagattttcatgtctttctgggtggaatggaaagtcgttaagaaatttatcaatttttttctaacatttcaaatttattggcataaagtttgtaataatatgcttgtttttcatgtctataggatttatagtgattcccttgtcctcattcctgatattggcaattagcatttttttcttttatttttatcagtcttagtagaaatttatcaattcagttccttttcaaagaattaacttctggctttgttgatatccatctcttcatctctgtattcactcataaattcgtcttattatattcctcaagcttggatatacattttcattattattcaattaaaatattttcttaatttccttgtgattttttgactcataaattgtttagaaatatatcaagacacttgtggattttattacctttgttattgatttttagtgtaatccattgtgttcagagcatatacgctatgtgatttcagacctttgaaatttattgatactttatggcttagtatatggtctattttgataaagtttcataaacacttgcaatgaatgtatatgttgcagttggtgattataggttctatgtatgttcagtttttcagtttgttgttcttctgtgtctttgattttttttttctacttgttatatcagttgctgaagaagaatattaaaatatcctactataaggatcttatgactgggcacagtggctcacacctataatcttaccaccttgggaggccaaggtggatggattgcctgagctcaggagtttgaggccagcttggacaacattatgaaaccccatctctactaaaaatataaaaaattagccaggcatggtgccacacgcctttagtatcagctgcttgggaggctgaggcacgagaaccacttgaacctaggaggtggaggttgcagtgagctgagattgcactccagcctgagggatagagcgagactctgtctcaaaaacaaagcaaaacaaaacaaaacaataagaaaaaagacattcaacacaatagaaatatggggaaaagacttcaacaggcacttcaaaagaagataccaaatgtcaagtaagtatatgaaaaggtgctcaatattactagtcatcagggatttgcaaattaaaattacaatgagttaaacacatagcccaaccaaaaaaggtaaaattaaaaaacgagcaatatcaagtgttagcaaggaagtggaacacactgactcttacacatcactggtattaatatgaattggtacagccactttagaaaactatttagcagtatcatttaaagctaaacatgcacatacctcactagtgagcaatttcattttagtgtatattcccagaggaaattagttcatttatccatcagaaataagcaaatattgtcaaaattcataaacaacccaaatgtccgtgaatagtagaataggtaagtaaatcatggtatatcatatgatggaataccatacagaaatgaaaatgaacaaactactgctgtatcacaacatgggtgaatttttttttccataaattcgaccaagtggtaagcatagataaattttatacacataaggccaggcgtggtggctcacgcctgtaatcccagcactttgagaggctgaggtgggaggatcagttgaggccaggagttcaagaccagcctggccaaaatggtgaaacctcatctctagtaaaaatacaaaaaaaattacctgggtgtggtggtgcttacctctaatcccagctacttggaaggctgaggcaggagaatcccttgatcccaggaggcagaggttgcagtgagccgagggtgcaccactgcactccagcctgggtgacagagcaagactccattgcaaaaaaaaaaataataataaatttatacacataatattgatcaaaagaagtcagacattaaagtacatacattatataacactatatttatgaagttcaagagtaaacaagactgatcaatggttataaaaggtcagagtagtctttacctttaagggagaatattgactaggaagggacacaagtaagccttctgggactctggaaatattctgtatcttaatgaggtgattggttatatggctatatatatattaattttacatatatatgttttatacttaagatttttccacttcattgtatgaagttatatcggtcattaaaaagtaaataaaacagggaggacttccaggtatagctgaatgaggagactggcagatcttcaacacaaaaaccaattatgaagattgacaaacttgacaaaattaaccattttaacactcttgaaatcaaccaaaaggcatacaataatttgagagaattttatgattaaaaaactgctggccgggtgcagtggctcacgcctgtaatcccagcactttgggaggccgaggtgggcggatcacaaggtcaggagattgagaccatcctggctaacacggtgaaaccccttctctactaaaaatacaaaaaattagccgggcatggtggcgggcacctgtagtcccggctgctcgggaggctgaggcaggagaatggtgtgaacccaggaggcggagcttgcagtgagccgagatagtgccactgcactccagcccgggcgacagaacaagactccgtctcaaaaaaaaaaaacaaaaaaaacaaaaaaaaaaactgctaaaattccgtaaaacagtaggagtttgtggtattcttgtctgggattgttcctattcccctttccccagctgatttgtcatgaaagttttaccagtgtgggtagaccatgaagaccagctgctttgatgctgtggttgaagggagtttactcagtttgggtggtggatgatgtccatgctcaatggcattgttgggagaagtgaccacttggcagtgggtgagtggcacaggccagtgactttgcctgtttgtggttggggcaagcatattgcaggctgaggcatgtacatgcacagaagagacatgataaggcccaacggaaagtaacagctagggcagacttgaaaaacctgaactttgaatgcactactctatatcccccatactccagacccataaacagaggataaaagcctttctagctttaagtatatgagcataaactctatctaatcattggctacacagacataggggtgactcctcaaaagccacatttaaacataaaaccaagaaataaaaagaaaatgagctgagacatcagtggctgcacactgttagggaaacagaattcacagatttagctcaggcaaatgattaagccaagaaagaaaaaaacaaactagtaacaacaattttcatgggtgaaagaaatcagaatccaaattgttcatatgttcaatttgtaaattgttcatatgcataatttgttttctaatcccatgacaggttatattcaatttttaattaaaaagccgtgagacatgtaaagatacaggaaaatgtgacccatgtttaggaaaaaagtcaacagaaattatctacaagtgtccctagatactggatttaacaaagatttcaaagtagcgactgtaaatgtgttcaaagacctaaaggaaaacatgtttaaataatttttaaaaacatatttatttatttttatttttatattttatagggacagagtcttaccatgttgcccaggctggtttcgaactcctggcctcaagtgaccttcttgccttggcctcccaaatctctggaattacaggtgtgagccactgtgccccatcttaaatactatttttttttttttttgagacagagtttcgctcttgttgcccaggctggagtgcaatggcacgatcttggtcaccgcaacctctgcctcccgggttcaagcaattctcctgcctcagcctcccgagtagctggtacaggcgtgcaccaccacgcccagctaattttgtatttttagtagagatggggtttctccacgttggtcaggctggtctcgaactcctgacctcaggttattgcccgcctctgccttccaaagtgctgggattataggcatgagccaccgcgcctggccccttaaatactgtttttttaagcatgacaacaatgaatcaataaatagaacttctcagctgagtgcagtggctcatgcttgtaatcccagtgcttttgggaggcaagcggggtggatttcctgagcccaggaatttgagactccatctacaaaaattttaaaattatttgagcatggcagcatatgtctgtggtcccagctacttgggaggctgaggcaggaggatcgcttgagcatattgagtgtttgcaccactgcattccagcctgggcaaaagagcaagactctgtctcaaaaaattaaaaataaaataaatagaaattctcaataagaaaagagaaatgatttttaaaaagaagcaaatgaaaccaaagaggatatacctatggcaaataaacacatgaaaagatgttttataattatctaatagttattaggtattaggaaaatgcaaatattaattagtattaggaaaatgcaaattaaaatagcaatgagatatcattacacacttatcagaatgcctaaaataagaaatagacacaataccaaaggtttgtgagaatgcagaaaaattggatttcttgtacattgctggtgggaatgtaaaatgatacagccactctggaaaataatttgacactttcttttttttgagacggagtctcgctctgttgcccaggctggaatgcaatggcgcgatcttggctcactgcaacctccgcctcctgggttcatgcgattctcctgcctcagcctcctgagtagctggtattacaggtgcctgccaccatgcccaggtaatttttgtatttttagtagagatggggtttcaccatgtgggccaggccggtcttgaactcctgatctcaagtgatccacttgcctcggcctcccaaagtgctaggattataggcgtgagccactgtgcccggctaatttgacactttcttataaaactaaactctcaccatatgaaccatatgatctggcagcttcactccttattgtatacccaagagaaaggaaagcatatgtccacataaaagtttatacatgaatgttcataacattattaataagagccacaaaatggaaacaacccaatatccattaactgatgatgtataaacaaaatatggtgtgtccacacattgaaatattgttcaaccataaaaagaaatgaagtactgatatatgctacagcattgaaaacattatgctaaatgaaagaagccagtcacaaaaggccacatattatattattccatttatatgaaatgtctgtaataggcaaatctataaagacagaaagtagattagtggttggctaggattggggagcatattggagaaatgaggagtggctgctactgggcatggggtttcttttggaggtaataaaaatgttctaaaattgccatgcgtggtgcacgttcctgtagtcccagctacttgggaggctgaggcaggaggattgcttgagcctaggagtttaagtccagcctgtgcaacatagcaagacctcgtctctttaaaaaaatgacacatataatgaaatgaaaatgtccttaaatttattgtgatgatagttcataactatgtgaatatactaaaaactattgaattgtaccctttaagtgggtgaaatgtatggtgtgtgaattgtatctcagtaaaattgttaacaaaaaatttttaaatgagtttatcaagatcacagggtgtaagatctatatagaaaagttaagtatatttctatatgctagctagaaatgaacaatccaaaaatgaaattaagaaaatattctgttcatgatagcattaaaaagaataaaataggaataaattgagcaaaaaaggtataagacttatacactaaaacttgtggaacattgctgacagaaattaaataaaatcagccaggtgtggtggctcacgcctgtaatcccaaacccagaggctgaggcggatggatcacctgaggtcaagagttccagaccggccgggtgtggtggctcacgcctgtaatcccagcactttgggaggctgaggtgggtggatcacctgaggtcaggagttcgagaccagtctggccaacatggttaaaccccatctctactaaaaatacaaatattagcctggcatggtggcagtcacctgtaatcccagctactcgggaggctgaggcgggagaatcgcttgaacccgggaggtggaggttgcagattgcagtgagccgagatcgcgccattgcactccagcctgggtcacaagagcgaaaccctgtctcaaaaaaaaaaaaaaaaagagttccagaccagcctgtccaacatggtgaaaccctgtctctaataaaaatacaaaaaattagctgggcgtggtggtgttcttttagttccagctacttgggaggctgaggcaggagaatcgcttgaacccagatggcagaggttgtaagtggagatcgtgccactgcactccagcctgggagacagagcgagactccatctcaaaaaagaaaaaaaaaagaaattaaataaaatctaaataaatggagaggcagtccatgttcatggattagaggactcaatattgtcaagacagcagttctccttaaattgatcataaattcacagtccatatcaaatttccagcagcctttctttttctttctagaatttgacaagccgatcctaaaatttacatggaaacaaaggacctagaatagccaaaacacttttgaaaagggaatgtgaagttggaggtcttcatactacctgatttcaaaacctactataaagtcacagttatcaagaccatgtggcattgcttcaaggctaggcatataggtcaatggatcagaatttagagtccacaaagaaacctttaaatatatggtcacttgattttttgacagagacacatccttgatccaagatttctctgcttgtaaaaacccaatgtaaaacagtctctcacagtgtgtgtgctgcagtataactcagactgtgttgcagtcaagctagcgaatgcatcactgtctgccgggtaaactgctacgtcatccttggtgtttggcatgttacaatgctgggatcagtgtgggcttctagttggattttgtgccaggtatgtgtctacgttggacactgttcatggtagattaaaagggggatgctttaaatttggagaaatgaatgtggctttttatttcttgtattctaatattagagaaagattgtgagcagcagtgtctataaaagatctatatagatctctagctttgcttttggacctgggtatgctgtgttagtgtttggttgtcgtagaaagatccgtttggtgaaaggaagcataaactcgattattgagtgtgcctctttagtatatttttctgatatagttgagtgcaaaatagtctgccttatttttacacttagtgctttatttgcatttttgaatggtgaacttgtataacaagtttgttttgtagacacttaagtgtgtgtaaaattgagcagcttctcatctgtggctactgaactttcctgaacaaaggctgcagtgctctatttttgagacaggttattctgaagagacgtaaagatagaagggctcctctgtgtcagcttggttctttaaagggaaagtaaacttgactaacttaatgggcattggcacattgtggaagggatgatgtgaagtacagaccagagaacaaccaggacttccattttttattatagctggttgtcatgttgggtggcctgattgagttgctttcaaatttgggcaacttgagtctttacaacttaagttgcccgaatgtccttcagatcaatgtttgtttgttgtaatcatttatcttttatctgattatttaacttctatctatgctccaggtcatttgtgtacttctgtttttgaaggtttttctggaagcttaatatattctcagcgtggttggcatcagattgttaactatttctatccagcattttgatgggaataaattttttatggttcatgattcaggttagatttggtgtacaggcctgaggacttgcctcaggaagttgtctttctatagattctaagcctttagggtcttttgccattgatttttctcctaatacacagaatatcatgagcatctacttaagtaaaagctaaaaacaggaagatattacaagataacattcagctagtgtttatttctttaagagatctgtctgtggcaaatttgctttcatagtaatatatgtgtctcagtaagtagtctttctaggcaggatttttcttccctgcttaagggggttagacctccaaaatatttgtcagggtctcttttccttttaagggtttaacccacaatcttttctgtatccgttttgtaccagctccattcctattctcaagctttggtgcataaaaccttagtttaggtgtctatatataccactactttggcctgaaaattagaatcgtggctcacacttgattctaagttccctagtagtggcgtgtttcctttctacgtgcttactttcccacctgacctgcttttccccaccgtgcagtctgataattggtattatttgttttgattggatctcagaaattacctctttagaccgagctgtgctcctccctctggatttcatgagcccattattttcttggcttaattgtccttgtaaatttggtctttttgtcctgggctttccctgtcatgtgctcctggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaaggtaagtgttaggctaccacatttgggtaatatatatatctttaaaaaaacagtaaggtactgacagctaagccctgagatttatttgatcattttttttctatctttaaaaaatgaaggctattttttttaagaaaatgaataaaaatgggcatattggctcctgaatgtctaaacctttattttatattgggaatttgaataaaagatccctgagcccatgtgtgatattttagctacgttgaaaacaagcaccccatgcagaccctgctgtgctattatttcctgaagggaacctcagatgtatcagatttactccctggatttggctagtatttccagtgaagtctcttcaactgctgtaaaggaaagatattgtatagttttgcagaaaacttttttagaatgtgtgtctggggctaggaaaggtgcctgctgtaattgtggtatgtagtcagacagagttgttcaggatgccgaactccttcactttgggacctttcttattgccattagaactcaggctgaggaggaaatgagtcaggccttcttgggccttcttcaggcctcttgcaggtctgcacctccctgcagagaattgacataaaagacttgaatgatttgcttgtgcagtggcgcggtcatagctcacagtagccttgaactcttgggctcaagtgatcctcccacctcagcctcctgggtagctgggactacaggcatgcaccatcatgcctggctaatttttttttcaagttttttgtagagatggggtctcactgtgttgcccaggctagtctcaaactcctatactcaagcaattctgccactttggcctccagaagtgttggtattacaggccactgtgcctggcatccctccattatcttttttgtttgcttgtttttataatgtagagtttttattttgaagaaaattactgaaagttaaactaaacttaggcaaagacagaaaataaacaaaaaacactgagttggcaaaatctgtctttagatcatccttttccattcctttttttcccccaactgcctctgtaattgcccctttttcttttttaccacttcttccaccctttgaggggataaccaagcaaaacttccactgagaggcaaagaggtataaaagtaactacaatatagctgagtgcagtggcatgagcctgtagtaccagctactctgtaggctgaggccagaggattgcttgagcccagcagtttgaggttgcagggagatatattcctgccactgcactgcagcctggtcaacagtgagaacccatctctaaaaattttttttccaaagtaactgagatatatataatctatgtttgtgtatatatataatatagtatcaaaattttttatgtatatacatgtataaatatatatttcaaaaatgtatatataggctgggcacggtggtggcttatgcctgtaatcccagtactttgcgaggccaaggcgggtggatcacctgaggtcacgagtacgagaccagcctggccaacatggtgaaaccccgtctctactaaaaatacaaaaattagctgggcgtggtggcaggcacctgtagtctcatctacttgggaggccaaggcaggagaattgcttgatcgagcaaacccaggaggcagaatttgcagtgagcagagatcacgccatcacactccagtctgggtgacaagagcgaaactccatctcaaaaaaaaagtgtgtatatatatatatatacacacacatatacatacacaaacacacgcacatatatacatatatatgtacacacacgcatgtgtgtgtggtttttttttttttttctttcgagacagagtttcacttttgtcgcccatgctagagtgtgatggcgcgatcttggctcaccacaacctctgcctcccgggttcaagcgattcccctgcctcagcctcccgagtagctgggattacaggcatgcaccactatgccccgctaattttgtttttttagtagagatggggtttctccatgttggtcagactggtctcgaactctcgacctcaggtgatatgcccgccttggcctctcaaagtgctgggattacaggcgtgagccaccgcgcccggccttaaatgtgttttatatataacatagtttttatataaaaacctcatggctatacatatagaaataaaacgtgcatatatatctctataagtatatattgatatatagtgtctgaatgtgtctttgccaaaatttatatgttgaggctgggcacggtggctcatgtctgtaacctcagcactttgggaggccgaggcgggcagatcacctgaggccaggagttcgagaccagcctgggcaacatggcgaaactccatctctactaaaaatacaaaaattagccgggtgtggtggtaggatcctgtaatcccagctactcaggtggttgaggcacgagaattgcttgaacctgggagatggaggttgcagtgacctgacattgtgctactgtactccagcctgggctacagagcgagactctgcctcacacacacacaaaatgtatatgttgaaatctaattaccactatgtcaagaagtggggcctttgggagttgagtagatcatggggcagagccctcatgaatgggattagtgcccttataaaataggctccaggcgaggcatggtggctcatgcctgtaatcccagcactttgggaggccgaggcaggcggatcatgaggtcaggagatcgagaccatcctggctaacatggtgaaaccccatctctactaaaaatacaaaaaattagccgggcgtggtggcgggcgcctctagtcccagctactctggaggctgagggaggagaatggtgtgaacccaggaggcagagcttgcagtgagccgagatctcaccactgcactccagactgggagagagagcgagactctgtctcaaaaaaaaaaaaaaaaaaaaaggctccaaagatctgcctttccccttccactctgtgaggacacaatgagaatcatgcaagcgagtaggacctggaggcagggaacccaagaactttctagaactaaatcaaatggaaacaagcacttcagttatgacaggaagcatcctcttcctttacataggatatacactgaataaatgactttgtaacttcatcatctttatttacacagggtgtataccaagtaacaatggaaatctctagagggtatttaaaccccagaaaattctgtaaccagacccttgagtggctggcttgcttgggccagctcccaacctgtagagtgtgctttcattttcttttttttattttttattttaattttttgattttttgaaatggagtctcgccctttagcccaggctggagtgcagtggtgcgatcttggctcattgaaacctttgcctcccgggttcaagcaattctcatgcctcagcctcccgagtagctgggactataggtgcccaccaccacgcccagctaattttttgtattttttagtagagatggggtttcactgtgttagccaggatggtcttgatctcctgacctcgtgatccacccgcctcagcctcccaatgtgttgggattacaggtgtgagccaccgtgcctggcctaatttttgtatttttagtagagacaacgtttcaacatgttggctaggctggtctcgaactcctgacctcatgttatccccccacatttacctcccaaagtgctggaattacagacatgagccactgtgcctggccgtgtgctttcattttcagttaagtctctgcttttgttgctttattctttccctgctttgtttgtgtgttttgttcaattctttgttcaaaacaccaagaacttgtacagcctccactggtaacatattttggcaagccagccaggaggtaatcccaaagtttggggtttatttttcttgtttgtttttcctgctccatacaggggaatctcagtctctctctctcttttcctttccaacttgggacggttggtgggcagcacctaaacacagaggcaactgcaggtttctggccggggccactctgaaggactcctttctatcttttccagttgtggtccctgatccctacgtgtggcacagcttggggcgagctggcatttgtttcagtgacttaaaccttgttttctcatgctaaattcttcccttcccctactctactggctaaggacaaaagaaacccacccagcctccagttcctatcattacagttcatggctatcactctagtggaacaggaagcatgggaaagtgtggccttatcaaattataaggatgccagaagtccaggccttcatccagggacaaaaggaaacctcatagtaggccattgcctctgaagggaaaacatgctaagcagcaccagtgcccacctaaggtcagagacgtctgacactctgagactggaccccaaagggggacggcccagggatcctccagacctcaacttctccaaaggggacaccctaggcagagttctgaggtctagtattaagccctccttagaattttctctcgcagttgcaatactgtttggcccaatattgtttggaatctggagcttgctgttgaatgggaaagtgggatggagttgcatgtgtcaaactgctgtggaaactgctatatctgaaattttggttcacagccttcattggattatctgttggggcaaacaaaggaaaaccccccaagcttgtattgctatctcatgccttaagattcccagttaaaagcgattgaatcttcgtttgtgtgcgtctatacatgtctagatgtgtttatttgtatgcacacttattgttacatgttgtgtctaccaaattggcttataaataaaagagcacttaaaaattaagtaaataagtctaagcaattttcaagttcacgtgacttaagtataactttactaaacaagctggctttaaaattattagtaaaataaaactagaaatgccttcagaattgtcagaatacattctttgtctggattttatatttgtctctgctaaatattttgagatgtcaatgtttggcatagaaggttataaaactactaacttagcccatacaaaatgatcttggtttgtgtgcccttttttttttcaacgaatgagagtaacttaatgttgttaactaagtcttctgagttattggcaaaaaaaaataccagtgtatttacctttaaggctgttacttaggtttaggtgagcaccttatgttcgctggctattaaaaacatggttagcaaggaaataactaactttaaatgatagtgtctgatatctctgtttatagaagttatctaaataaaccgttaaacatgaaagaattgagtacagtgaatgggataaatgttttaggtaatctttttgtgtaaattaaaatcttggccaggcgtggtggctcatgcctataatcccagcactttggaaggccaaggagggtggatcacccgaggtcaggagttcgagaccagcctggccagtggcgaaaccccatctctactgaaaatataaaaactagctgggcatggtggtgtgtgcctgtaatcccagctactggggggctgaggctggagaattgcttgaacctgggaagaggaggttacagtgagttgagattacaccactacactccagcctgggggacagagcaagactctgtcacaaaaaaaaaaaaaaaaaaaaaagtcctaaaattatttttgatgctcattgaatatctgggtcagttccaattaagaaaaggttgtgacatggggaaatatgtttctacaaattgtggaattgttcttatctataatgcttttatctctgatggttcaggatttcttgctttttcgggtttcattgaagttttaggttactaaggataagaattctagttaacacataattctatatacaaaatgtgccagaaagtgttgtgtgattagtgagaaaaaataataattttgtctaattcggaagttttctaaaagttagttcaaattacagatttgaaaaggttatttatgaaacaatgtagtaaggaaccggtaaggaggggagaaagacgtggaaaagtttagataataaaatattgcttaaaacctgatagagaactggagaaatttggctaattaacattttcatagttaaagttcttagtcttgattaaagtaaaaataagtattgtaaaaaaaaatgtgtcggcagtttgccagtttttttaatatatagttaagcatgaagccggatttagtgtggagccaaatttcacatatgtgcttgcattgcttcacactttgtttcctgttttgcacgggtagtgccggcactgaagtacttattggtcatttgcctagagtcaatttctttttttttgagactaagtcttgctctgttgcctaggctggagtgcagtggtgcgctctcagctcactgcaacctctgcctcccagattcaagcgattctcctgtctcagcttcccaggtagctgggactacaggcacacaccaccacgcccagctaatttttgtttttgttttttttaagtagagatgtggttttgccatgttggcaaggctggccttgaattcctggcctcaagccatcctctcaccttggcctcccgaagtgctgggattacagatgtgagccaccgcacctggcctttcttaaactctttatccttttttattctcttcttttcattttgaaatctttcaggatgatgcacagaaaaatgcttatgtttaaagtctgatctttcttttaacttgcttatagaatgccttttttttgttaacttctggctttcccttgagaggactttatatactttgccctgtttagaaagttccaaggggaatcaaagcttgtttttctcaagatgctttgagaatttcatagcagcataatggcagcaagggtaaaccttgaaagactatcattacaaagtctaactgtttaatgctttttaactggtaagtttagtgtttgccccttactgctttacttagcaagttgaaactatattcacaaaacaaaatcatacaaatttacatgatgttatacagttatatagagctctacaaatgctcgtatcaccctctttaaaattacctattatcccttaggccattgaacaggtaacacatttccgcaagggtagttcagctttgcttactagatgcataagcacatttttaattgaatatatgacattcatactatgttttgtgcaaagttaaaaaattacttcttagagcagtcaaattaacattctagtatcttcacatttttacagtttcaatgaaaaaaaaaattctcctaaaaggcactgccttttactcttgccctttccttcatgtttaattttatcttaattttttgataactataagactacatttatttagtatatgtcatctcagattagtataatcgtatcagtcatttatttaataacatcatcaggtgttctttcagttcttgagagaattgagatttgtaatggttagtatgactggcatgtatttggggcttatatgtaaacattggaagacatgggcagcaaagatctaagaaatttgttctccaaaaactgttttaaagaaacatcacctggtatttgctctaaagtaagctcgtccaaatcactgcccatggactgcatgtagcccaggacagctttggatgaggcccaacacagctttggatgaggcccaacacaaattcataaacttgcttaaaatattatgagatttttgaccaggtgcggtggctcacacctgtaattccagcactttgggaggctgaggcgggtggatcacctgaggttgggagctcgagaccagcctgaccaacatagagaaaccccatctctactaaaaacacaaaattagccgggcatggtggcgcatgcctgtaatcccagctactcgggaaggctgaggcaggagaatcgcttgaacccaggaggtggaggttgcggtgagctgagattgcaccattgtactccagcctgggcaacaagagcgaaactccatctcaaaacaaaaacaaaaacaaatattatgagatgtgtgtgtgtgtgtgtgtgtgtgtgtgtgtgtgtgtgtgtatgtgtttttcatcagctatcattagtgttagtgtgtttctttttcttttttttttttttttttgagacagagtcttgctctgttgccaggctggagtgtagtggcgtgatctcggctcactgcaacctctacctcccaggttcaagtgattctcctgcctcagcttcccaagtagctgggactacaggcacacgccaccacgcccgactaattttttgtatttttattagagatggggtttcaccttgttggccaggatggccttgatatcttgacctcgtggtccacctacctcagcctcccaaagtgctggaattcaggcaagagccactgtgcccgccagtgttagcgtattttatacgtggcccaagacaattcttcttccagtgtggcccagggaagcaaaaagattggatacccctgctctaaaaacataattatttacatggatatacagtgaataattaactgtgactatattcagtgcaggttaacttgaggcagtattgtagggtatcaagttcaaggacttagagtcagaaaggttgaattcagatctgttttgttacttctggctgtgtgaatgatcatgggcaagttacctaatccctctgagcctcacttgtaaaatggtgctcaaacatcatagcattattgcgaggattaatatgccagtgcatgtgaagagcttagcatagtgtctgtcccatagcgagtactcagaaatagtgttattttgtgtagttgtcaataattaataaataataatcaccattcaaaaatgtttgagcaggctaggtatggtggctcacacttgtaatcccagcattttggaaggctgaggcaggcagatcacttgagaccaggaagttgagaccagcctggccaacatggtgaaaccccgtctgtgctaaaaatagaaaaaattagtcgagcgtggtggcacatgcctgtaattccagctacttgggaggctgaggcacaagaatcgcttgaacctgggaggcggaggttgcaataagccgagattggaccactgcactccagcctgggtgacagagtgagactctgtctaaaaaaaaaacccaaagatgtttgaacagcttctatctgtgccaggtaccctttggtgctggagatacagcaataaataagaatctctgacctcaagggatgaataagagtatctgacctcaaggaacacacactatttatcagggaaaacagatgtgttaagctcatgtaacagtccagtgtgattgggaggaaagatgtaagtgcatgttctggtgtggcacagaggaagctcagttacctacctccttaaggggtgaagttggaaggatccccatcagcaaaggctcactgggagcactgacagtttagttgcattttgaagaatgaattggagtagtactgacaaaaatactataatgcagtggtggattcctgttgttgagaaagccaagctgtaatagagtagattatattactgccggagagcacatggtattggttaggtatctaaatgtatatggggtaatggaaaaatggaagttcctaagaagatcagtcctagtttgcattttgattgacatttttgtatcctcagactttgaaatactcgtgggatatgaagtggaggtgcctagagggttgaagataatgaggacagatgaagaaatgtttgattgtgccatacttacagttgctgattttcaaggtgtgggtacttccttagccttattctctgtgttacctttcaataccattagtaacagttctttaaaagccaactttactgaggaataatttacagccagatatacctgttttatgtggacagttaaatgatttttttgttttttgttttttttttgagatggagtctaactctgtcacccaggctagagtgcagtggcgtgatcttggctcactgcaacctctgtctcctgggttcaagcgattctcctgctcagcctcccaagtagctgggactacaggcgcctgccaccacgtctggctaatttttgtaattttagtagagacggggtttcaccatattggttaggctggtctcgaactcctgacctcaagtgatccatccgcctcagcctcccaaagtgctgggattacaggcgggagccaccatgcctggcaggtaaatgagtattttcaaaagtcaggtttgttgaggtataatttaagtacagtaaagtttaccctttttttttggtggagcgggggcaggatctcactctgtcacctaggctggagtgcagtggtgtgatcatagcttactgcagcctagtcttcctggctcaagtgattctcccacctcagcctcctaagtagctgggactataggcgtgtgccaccaaggccggctaattttttgatttttttgtatagatgagctctttctatgttgcccaggctggtcttgaactcctgggctcaagcaatccttctgccttgccctcccagagtgctgggtttacacgtgtgaaccaatgtaccaggccaagttcaccttttaaaattatgtagtttgatggttttaacacatatatctacccatgtaaccattactatgagatcaagatatagaacgtttccatcattcccatactcccttgcagtcggttcccacagccccagcccactgattcgtgttctgcactgtagattagttatccttgtcatataaatggagtcatatggtatatacttttttgtgtctggtttccttctctgaacatgaggtttttgagattcattcatgttattgctcagtctgatacactgataatgatccatggacttggggcccaaaagaaataggttcatgacaaagttaaggacaggaaggtaatttttatttatttaaaaatacatgcaataataaaaaaattaaaaagaatgtatgaaagaaaaatgaagtgattaaaaaaatgaaacaaaacatgtacactggcactgtttttagacctctggtgtttattatcattagatatgttgcatagtgtaattggaagaacattgaaatgaccatgaaacctggttttctggtctatatatgctacagacttcctttgtgaccttagacaaatcattctccttgtgggcctctttttctataaggtgcctcttaactttaaagttccagtccagatgcagtataactaaatacctggatagaaaaggatgaagaaaattttaatagattgaccagcttgaaatgtcagtctctaagaagggtacagagcattttatattgagtgccaacagcagagtgcatagcctttgttatgtctgtccttaagtctagtaggcaaagtagctgctagactctgaactgtcccttcttgtttttttttttttgtctttttgtttttgagacagagtctcgctctgtcgcccaggctggagggcagtggcttgatctctgctcactgcaacctccgccccctgggttcaagtgattctcccacctcagcctcctgagtagctgggattacagacgtgcaccaccatgcctggatatttggtttttttttttttttttttttagtagagacgtggtttcgccatgttggccaagctggtctagaactcctggcctcaagtgatccgcctgccttggcctcccaaagtgctgggattacaggtgtgagccaccatgcctggccttgtcccttcttgttatactcccgtaggtggtggttttgcaagttaagagccacactaagtcatgtgaagtatagggaaaatgcccactcattgagttttatgcatagagacactcagagaagaaagaaagactggtcttatttatgtatgtatatgtaaaactatatgtgcacagaaagctagatattgtgctgcatgtgggaagattttaatcataccttcttattttgaaaagacaccttactgccccatcaagtttaaattgtaggggaagggaagaaaaggtgggaataggaaaagaaaacagctgtctatcaaacggtgtacaaaggagcttatgtccactatcttatttaatcctctgaacactcttttggagggtctatcagtcaaggtgcagtcacaaggaaaataaattgtagtaggtgttataaacagagaacattcaatagcgagaattgcataattgggtgttagaagaataaaagaacaacaacaaaaaaggcatgctgaggtaccccagagttaataactagaggaagtagctatcacctctaagtctgggagaacaaaaggggaggtagtgttaccagaactaggagcttggtggagatctcctggagggctggtgcctggacctctgggcataagctttgggtagctggtactcagatccttggcctgacaggtgattgataggcccaggcagtgaggtccagaggatgagtgagcatggcaaggttgatattctgactgccaaagagccacaacccactgctgctggtacctctatggcttttcaccagactgttgaaagaagctagagactggaattaagtttctgttacagctggagcaatactgataacagctgggaaataggaaggaaggcccttttcttacctttctgccttccggtttggtgaacagaacaggaaggagctagcaaaggagtcttggaaatgaagtttgcagaatcttggccccattgtcacagagcacagcataaaagggtaggtttggagctgagagacaataggtaaataaccaggacagtaaatatcatgcatattttacaaagagaacactgaagctgaaaaggttaaattatttgcaaaagatcatttaagtggacagatctggaatgtaaacccaggcctgtgctgtttccactatcatattttgtctaatccaaggtgccattgattgttagaaacactgttattttatgtaccactaagaaaaaatacagtactgccagccaggcgcggtggctcatgcctgtaatcacaacactttggaaggccgaggtgggcggatcacctgaggtcaggagttcgagaccagcctggtcaacatggcgaaaccttgtctctactaaaaatacaaaaattagccaggtgtggtggcgcgcctacagtctcagctactctgcaggctgaggcaggagcatcgcttgaacctgggagtcgaaggttgtagtgagttgagatctggccagtgcattccaacctgggcgacagagtgagactctggctcaaaacaacaacaaaaacagtactgccaatttaataaggcatcaattgtaaaatacataccaatttcagattttttttttgagacacccatctcattctgttacccaggctagagtgcagtagcatgactatgacttactgcagcctcaaccacacgtgcccaagcaatttatctgcctcagctgcgccccccaccccccaccccaagtaactggggctacaggaacacacgactgtgccagctaatttttgtattttttttatagacagggttttgccatgttgcctaggctggtctcgaattcctggtctcaagccatcctctcatctcagcctcccaaagtgctgggattacaggcatgagccactgcacccggcctaggagatttttttaaagtaaaaagaaaagaagtagaaccttaaaactgattaaatatggcatattatgctgccttgtaaagaattttgttttggagttgttgattttgaaatacctaggagatacccaggtaaaacatttagtaggcagttttaaaatgtggagttatagctcagaagaaagatagaagtcagagatacagaggtgaaggtcatctgcacaccagagtcgtgatccagaaacaaccctggtaacttgttttttggctttaacggtctctgagtctattatttctaccatttatcctttgcctatctctttgtgatggcatctgctggtaaaccttgatattatcttttattattcagaaacgcttttttttccttaaatttccacaagcaagatcattttcttttctctcttttatttgaaaagtacgtgacctgccagcatgcagtcttcacaggatgcagttgtgaaagtactgttatgggtatggtagtgaaaagcaggtctccagaaaatataggtggtgtttttatggcttctgtatttttataggtccagcatgtctggcttgcacctagtaaagcagggccgagacagaaagaaaatagattctcaacgagatttcactgtggcttctccagcagaatttgttactcgctttgggggaaataaagtgattgagaaggtaagttgtaacttgctgaattattttgtcaaaagcacttaggatttaatgcttgcctagatttgttgtctagatttgctcccaattgatatttagtttctcagaggctttgcctctttatgtgaattttagcctttctgcctccctagcatcctattaatataatttcactgttttcctataatatgtatttaccacagataatttaatcatagctaattaaggagttaaaatagtgctcataaagttatttttgagtcccagcaacttggggggctaaaatggaaggatcacttgagcccaggagttcaaggttgcagtgagctatggattgtgccactgcactccaacgtgggcgacagagggaccctgtctcaaacaaaacatgtttttgaaagatcttgtggttttacagggtggggctgcactgatctgacagggtatgaagaattgattagcttgtgggtgctggtggggagataatatgccacagcactggtttgaaagctaagggagtagagagagtttcagaagagaaggcttaaagagtttgatacactgtgacttactggcttccaccaagtatttgagatgtttcaagggaatataccacatgatatacttagagattccaggtattttgaaatgtaattccgtgtcacttttgtctaaaccatgtcagagctgagaggatgacttggctgaaatagcttccagtgattaaaagattaaaggatggggacctgtatttccactcctaaaagtattacttcatcagcatccttttattagtcttccaataaagacagattatgtgtctattagtctgtgttatccttagaggcatgactgcaagataggtaaggagacgaaaggtttgtttacagaaagtctcaggattattctatttttctacaacagtgaccattctttctgaggcattctctacaattctaaggtattggagttcagtattttggagaaaagtaactaataccagggtttttaaacatgttcagtgctctgtacctcattttattgcaacagagaagagtgcatggcactgcactggttggccttcccccattcctgatttcataatataccatacccacaatatggtagtatggtagaataattcacaaagtcacagatttaagtaattgtgacttttcccttcaaataaatgaagttagaaaggagtatgttttagctggcacatactcaagtatttgcttagttaacatttaaagatactgcttggccttggggaagccagtttctaacagtctggaccagtaacaagaattcttggttgaaagtatgacttttacacagaaagatagatatgtaaaaattctctcatctcttttcctccattgttgcttttttctgccttttcttcccattcccatctccttccccctcccaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcaggtgagttattagcattatgaaagcatcactctcaaaactaaaacatggaacagcacagcctttaagtaggagaatgttaacttagggggattcccaaacataggacttccaagtaaaatccttttaaaataatttctgtttaaaatgtgtcagtaatagacatataaaaatgattgcactatagtcaacctcgatacagattcctgtgtcctagggataagtaggaagaaatttaacaaaagtgttgatttgggctttcaagtgtatgcctttttcagtgttaaatatttgctatgccacattctttggaatgcgtaagtggaaagatttagaaggaaatgctgttttttccttatgcgttatattgaattatagaaaaactttgggttaagattttttttttctcttcctgagggagagaccttttgggaccgaagtgtgtttcactctgtaaattcggctacatattctttttactcagatggttctctgtctgatagttgtagataaagactgttggtatagctgaaagatatgactagtctttcttctccataccttctatcactaaggtataatctcttaaggtagagtacccacagataatgtgaagagctatgtttttttacttttttttatcttttactcctaggaagctgcgaaaaagagctatccttttatacttattttagtctgcatatgttttttctttgttgagacaatggtattatgattattcctaagaaagaaaggttattatatcatcttatttagaaattgagaagacaccaatttattagaaagcaaatgttatatattagatcattcttgcattgctataaagaaatacctgaggctgcgtaatttgtaaagaaaagaggtttaattggctcacaattctacaggctttacaggaagcatggtgctggcatctgctctgcttctggggaggcctcaggacacttactgggggaagatgaagggggagtaggcacatcacatagccagagcaggaacaacacagagaattgtggggagggtgccacacacttttaaacaaccagatctcatgtgaacttagagtgagaactcacgtatcatcaaggagatggcccaagccattcatgagggagctgccctcatgatccaaacacctcctaccaggccccatttccgagactggggattacaattcaatatgatatttggtgagggacatacattcaaactatatcatgttattatatgaaatcatttagatgcacactttcacatctctgagccacaagtttcatacttataaaaggaagatcctaatgtctaattcactggataattgtaaagatgagatcatctataataaatacagattaacttgcgtggtttttttcttttttcttttgagagggagtcttgctgtgtcaccaggctgcagtgcagtggtgcaaactcagctcactgcaacctccgcctcctgggttcatgcaattcttctgtctcagcctcccaagtagctgggactacaggtgtgtgccaccatgcccagctaatttttgtatttttagtacagacagggtttcaccatgttggccaggatggtctcggtatcttgaccttgtgatccacctgcctcggcctcccaaagtactaggattacaggtgtaagccactgcgcccggtccggtttctttttcctcattcatttctacctggtactccaattaattcatttattcattcacttaacatggagactgacagttgaataagatgtgatcttgttctaggaaacaaatgatttcaatacaatgaggtaagtgctataaaagaaacatgcacagggtccggtgagaacacagagatgagacatctaattcttgggggcaggcttaagagaaagctttcttaggctgagtgtggtggctcatgcctgtaatcccagcactttgggatgctcaagcgggtggatcacttgaggtcaggagtttgggaccagcctggtcaacatgatgaaaccccatctctactaaaaatacaaaaatgagctgggcatggtgctggtgcccgtaaatccagctactcggaagctgaggcaggagaatcgcatgaacccaggaggaggaggttgtggtgagctgagatcgtgccactgcattccagcctgggccacaaagcgagactcagtctcaatgaaaaaaaaaaaaaaaaagagagaaagacagctttctgaaagagattatgtctaaccaagaatgagtaagagttagtgaagcaattggggggagagaaaggtgtaccagacagaaagaacagcattgcaaatgcataaaggtatgacacaagtggttttctagaaattacggatggctacaagatgtgatgtagtatttgccaagggggaccttgttttccatcctcaaaagcacagactttgtcttttaaggagagtatgtgtgtgtgttggacatctaaggatttgcattttaaatgaatgtgttttttggggtgtgtgtgtgtgtgtgtgtgtgtgtgtgtgtgtgtgttaactatgtaaaagttgaagagtataatgaatcccttcccatctacctgtcatgcaatatcaataattatcaacttatggcgaatctagtttcatctatattcttaaccccgtgcacaattattttgatgcaaatccttgataccatattattcttcatgttatctgtgaagatactctaccttaagattaagagattataccttattgataaaaagcatggagggccaggcatggtggtttacgcctgtaatctcagcactttgggaggccaaggcaggcggatcacttgaacccaggagttcaaggtcagcctggaccatgtggtgaaattgtctctacaaaaaatgcaaaaattagctgggcatagaggcgcatgccggtagtctcagctactccggaggctgaggtgggagaatcactttagcccgggaggtcgaggtcgcagtgagccatgaccatgccactgcattccagtctgggtgtcagagtgagatctggtctcaaaaacaaacaaacaaacaaaaaagaaatctaaaccaaaacaatactaaagatttttttttaacttacaaaactcacaaaattgaagacattgataatacctaacataggtgagagtatttggtacccatgttgctagtgagagtctgaaaatgtgaataccttttgacccaatagttttattgctagtaacatatctgtggatataattggacagccgtacagagacacacattattttattatttttcaaattatacataatctgtacttccattgataagttagtagtcaaatgaattatataggctattgaaatattaggtatccataaaaaatattaaacatatatataccaaaaatatatatatttatgtacagtaaagcataaactggttgtctttgaggtgggacaataggtgagagtctcactctgtcccccaggctggagtgcagtggcgcaatctcggctcactgcaacctctgcctcctgggttcaagcgactctcatgcctcagcctcccgagtggctgggattacaggtgcccaccaccaggcccagctaattttttttttttttttttagacggagtcttgctctgtcacccaggttggtgcagtggcgtgatctcagcttactgcaacctctgcctcccaggttcaagcgattctcctgcctcagcctccctcagcctcactctgtctgtggtgggactacaggcttgtgccaccatccccggctaattttttgtatttttagtagagatggggtttcaccatgttagccaggatggtctccatctcctgacctcgtgatccgcccacctcagcctcccaaaatgctaggattacaggcgtgagccactgcgcctggccaattttcacttttaaaatatagtattgttatattctgttgtattatctaacattgtttaataatttgcatgctttccttcctataatcaaagagaacaataagcctattttaattttgaagaaattctagcggaattttttttagtagaattttttttagaagggacttaaaatcttttagaaataagaacaagataatcaccattctgactggcatgagatgatatctcattatggttttgatttgcatttctctaatgatcactgatgttgaggttttttttaaaatatgtttgttggccgcataaatgtcttcttttgagaagtgtctgtctgttcctgtcctttaccagtgcatgtggggcttaatacctaggtgatgggttgataggtacagcaaaccaccatggcacacgtttacctatgtaacaaacctggatgtcctgcacatgtatcctggaacttacatttttaaaaaagaacaagataaaataaatttattattagtaaataatggtggatgcttgagttgaaatttgaaagctaaaataaatttataaatggtggaaatgaactttgaggaagttacttaactcctccaagccatcattttctgtcacatattgggttgatgagagaattaaatgagataatatatatacaaagtgctagttacagtccctacacgtggtagctcttctgttacaggtgtcattgccagaataggaaaatagagatgttaggtgacaaatttgaaagggaatactgtacaacaaatatatatgagaaagtggttatctttctaaagtttcttacaaatacctgttaccctcagtattccagataaactctttccagacactcctgtaactaacctttcttgtttagccagtttgcaagccattcaggctctcctatctttctccattctgtcaagctctgtaccaggaaaagggctttctctaggtccagtaccagttaaagacaaaggatgtcaggactagaactttttctcggaatagagtaattgcacttgggcccctaactgacagacacatcagccttgatatagaagtcataaagattcctcagaaagattacatagtgaaatgttggagaattgctattttactataagagcttctaaatatgggattaactcgtattagtgcttgtgacttaacaaactaagagcctcgaactaaatggtcctggaaattatcctactaatgctgtttgtcctgtggttacttatgatagtccctgacctttacgtagttttgctgtgcaattatatttctggaaaaaaaaatcatgtgttctctattaattcgcttgcattttcagaatacattaagatggcagatcactatgtgccagtgcctggaggaccaaacaacaacaactatgcaaatgtggaattaattcttgatattgctaaaaggatcccagtacaagtaagagatgccaatgtgtcctttaaaaccaaattcagccattttatagttaggcacaaggggatatctagagaagaacatttttgtaaagcatcattttcgaaaattattaaatgcctgtgtatgggataactaaaccaaataaggaaaagaaagatggaaataatggaatggctaaaaataaagtaaacgtaatacaaacagaaggtttggaagcatctttcagagattatttattctaggtatctcacctttgagccagtaaaaattacctgtttgttgtggaatattagcctaaaggatggtggtatattaaagaagtaggctgtttcttccctgtcacattgtgttagtaagtttagggtaggtaccttaaagcccaaagaggaaaaaactctaaacttagatggcagtgtaatcaataatgatgtaatggcgtggccatagtaattgaatatgtgaaacatagccagtttttctagaaaacgccctttacagcctaggctatgaattgagtttcctaaagagcaacaagtataactggatcttaatatcaatttcaacttggttttgaccccttcagaaatcttgccacaatggactacttattgttactctgtaaagagtttgccaacaatcaagcatagaagctgaattaagcattaggctgctgtggaactactgtacctcaagaaacagggccagcctggatagagactcttgcagtttgtgggggttttgtatgaattttaagaatgaattatattgtattcccttgcaggcagtgtgggctggctggggtcatgcttctgagaatcccaaactaccggaacttctcttgaaaaatggcattgccttcatgggtaagctgttctgacatattgtccgtctttctgtttctttctgtcaattttgcccacattttactctatagtctgattttctgtttaacatgtgctgggctctctctctctttttttttccctcaatctattactaactctcagagtaaccctcttcatttctttcttttttttcattttttgcttatctcacttcatcttgattttgttttctgtccctgggtcagatatggagatatggagaaggctttggtttctaaaactctgaccttttaaaactttgcagctaaccttaagaaagcatgtgggaaaatgacctgtttttagatagtgaagataattgaatactcaggatgccttggcagtgtgcccttaaatatgaatcagcacctgtgcatttaagcatataggtgatactcctacaagtgagagatacttcttctgacttttctgctgtcattataccagagagaaaaacagaggttatatagctcaaagtatttttctctctgtctcagagaccttaaacaatgaagattatgttttgtaaacctttttaaagatgtctcctttttgggttcccctaagaccaaagagcgtatactatttcagacttgaatcctaaaactttaaagtccttatttcaggatattgacttaaaaaagaagactttattgatctggtgaagttggatcatgaagaatgataacattatagctagatttgtcaaaaatttaattcagcatacatttatatatattgagctctcactctgcacaaaaagcttactacattaggttttacagatggtacaaagataagtcaaagcataatagtccccataatttatgatctccttgatatgtgaggggtggggggaggacaagacaaatacataaatagctataatacaaggcaactacatgtgccagaaatgaggccaaggggttacagtcaggattcttttcctgtttcgtttttaggtcctccaagccaggccatgtgggctttaggggataagattgcatcttccatagtggctcaaactgcaggtatcccaactcttccctggagcggcagtggtaagaactgaattcttgtttgtatcttgaagtacagaatagctcagtaggatatttgggacttacctcttttgaaaaagtattggtatacttgacaagaaatggaatactggttgattaatggtaccttgtagctcctagcttaattaatacacctgtgattcttttagtaatataaatttagttccaggtacacagatgctaaattgtgatctggagtgatcttgtgagttaacttagaaaaactctgggaaaacatatatatggttttgtgggtttagatgtactctgggtaggctagaatcttcctcagaggtgggcttcccagggggaattgggtcttcagacctgcctgggagtagcctggatcactaggaaaaacctaaaacccacttactcaaatgtttccttgccaatgttttttttctttttttttctttttttttttttttttttgagttggagtctcactctgttgcccaggctggagtgcagtggcatgatcttggcttactgcatcctccaccttccgggttcaagcaattctctgcctcagcctcccgagtagctgggattacaggcacccgccaccacacccggctaatttttgtatttttttgtagagacaggctttcaccatcttggccaggctggtgttgaactcctgaccttgtgatctacctgccttggcctcccaaagtgctgggattacaggcatgagccaccgcgcctggcgccaatgttttcttgatatcaacccacaatctattgatgatttgatttgactgtttaaaaaccattcaacctcagttgcccttgatgcagaaaatgaggtcagtaattaacctttcttccaggcatgccagaggggcaagaattttcaaaaagtgatttattctcaacacatcccttaaacagttccatgtgaattattatagctgataacaatatgaaccttttttttttttttcttaagtactcaagcactgggaacagacatacactaaaacctcttttaaatgggaatgaccactgtcttgaggctgaacagatttgaacccttgttactctggctctccagggagattgcaatatcctctccagatctgctgggtcaaatagtttaaaataaaaggttgaatttgttcttgtttgaatggagaggctatagtgttccccttatggctgagtacagggacgttcagagagcatggaatcatgactctgctgaggccaataaaaccgccatttctatttccaagggctcataaagattgaattatttcccagacctcttggccctggagcaggcctgaacacacagtttgaaggtattttgcctgctgagttgctgtgagaagtatgctatgttctttttttgtttgttttgatcttgtacgtctttgcatttttataagttgctccctgttagttcggctggcttttgccagcgttaagaacccaagttgccgggtcatgctgtggctaaatcctgttaaccccaaggactgatcagggttttatggcatccttctttctcccatccactctcagttttgggtaaatatgatagcatttcaaagaatgcagagcagaaaattgacaagagcagaagatcttgtaattgccctaagttgctattgtctgttgcaggtcttcgtgtggactggcaggaaaatgatttttcaaaacgtatcttaaatgttccccaggagctatatgaaaaaggttatgtgaaagatgtggatgatgggctacaggtaggttactaactccagggagtgatacctttcagctgaccagttatagtcacaaatgtggagattgggagcctggctcgtgatatatacccaaggtggtgttagggatgtaagaccaggaggtgtagtttgaaagtatagaatacgctggtttctctttagattgcataagtcttttgcctttaaaaagtacagattgaggaagtgactttaaatgtaaacaatctaaattcattttgaagcaggctgctcatctggacagaacatttcttaggtgattaagtcagagttttaaggaggtgctgattctctctctctctaccacctgttagtgtgtgagggcggggacaacaaacaacatactttttctactggttgaattcagaaccaagaagccaggaagcagagatcaaacagtcagctttattatgaacagagatgttgatgaaaatggcttaagtgtgtagcaacattcagatttgtaaactaaacaccagagttaagcaggctcactcacccactggttactggcagtgctgaatgaccacagatttccctcgacagagagagagagcttaattcagcttagtgtatggctgagagctgacaaagagcatatgtcctgtgcagtgggctgatcccaaaggggaaaaggctgagctatgcatattcagtccctccttccaagttgaccaatcacataatttattatttttcccttggggaggagcaagggagtgaaccaagaaagactgaaagtgttactcttaattattgtctatccatgtagaaatgtgaacctaggcaaaaggagatcctttccccaacattaccttttctttccttacagttccctccaatttgttcccctttcacttttataaatagtttaaagtgttggttatgcttccaggtataatgaaagataatgaaagaggctattgtagaaaaatacactgcttgagtttgacttgtgtcatgtaaattcaagagggatgctgaatgttcaaataattttgttgtattgtttgcattttaagttaaacatcctgtaatctccttaataagaagaattaatatttctaattgaatttcaaatgctttattttgtttgttataatttgcaaaagagtagaagctctttgtaaggaactagctattctagctattttgcttatcgactaacattcttttttattttttctggttataattataaacagcattttctggtagaaaatttgaaaagccaaagatgatgataaagccacatgcaaacacaccatccaaagataatgcccattaacctattcatttttttatcccttttcaactcatagatttatatcatatacaaatctttattaatagattcctatacttataattatgataattataagttttgggtcttactatttgtattgtgttggtaatcataatacttttttctacttaatatttttttgtccttctacctccccgctccttacttaacattatattaaagtgttaaaattcttccaaaatatttttaatgggtgacctgtgactaaagctttcatatatttttaaaaggcctaccttcttacttactgacctcctatgggatacccccttttttttttaagtctttctcttttttttaagctatctctttgatcatctatcactcagcaattgagttcatcatactaattctgtttatatgagcatagaaaagaataaagaaacattagaaaaggtgagactgtgcataaaagattttcattcattaagtaatcgattgacatagattaaaaattgaaatgttctttttctgggtgatacttattttattttatttttttgggttggagtctcactctgttgcccaggctggagtacagtgatgccatcttggctcaccgcaacctccacttcccagattcaagtgattctcctgcctcagcctccaagtggctgtgattacaggttaccgccaccatgcccagctaatttttgtatttttagtgcagacagggtttcaccaagttgggctggctggtctccaactcctgacctcaagtgatccacccactttggcctcccaaagtgctgggattacaggtgtgaagcactgggccaggcctggtgatacattttaaagatattcttataatgtagcaaaaccttaaaagactggaatattttgacaaaggaatgacttggttattttattgaaacagggtctcactttgttgcccaagctggaatgcattggcacgatcttggctcattgcaacctttgcctctcaggttcaagcaattctcgtgccgcagcctcccgagtagctgggattataggcatgcagtaccacgcccagctaattttttgtatttttaatagggccaggggtttcaccatgttggccaggctggtctcgaactcctgacctcaggtgatccacctgcctcagcctctcaaagtgttgggattacaggcacgagccactacgcccaaccccacttcagcttattttaagtgaactccttatgtcttttttttttttaattgtaatacatgtatgcctgcatactataagcaagaaattccaataatgcagaaatacatacagtgaaaaaggaaagttttatatccacgcatctttctttgttttttgtttttgttttttttgagatggagtttcgctcttgttgcccaggctggagtgcaatggcgtgatcttggctcactgcaacctccacctcccaggttcaagcgattctcctgcctcagcctcccaagtagctgggattacaggcatgcgccatcacacccagctaattttgtatttttagtagagacggggtttctccatgttggtcaggctggtcttgaactcccgacctcaggtgatccgcccgccttggcctcccaaagtgctgtgattacaggcgttagccactgtgcccggacccattcttttctaaatcattgctggtatgtactctggacttcacttctttgcacttacatgtgtgggtgtatgaatgcatatataattttgtttttgacccatgtgacattactttagattgaaccataagaaattgcctatattcagtcatttttttaaatctatgaaaaaggcaatttcttttggttcaacctaatactacaaatattgttctactatttattttttcatagtgtatcttgaagatctttctattttattgtatttagaattactaaatgactgcattcttaaagggagaaaaatgccagttttctccttccctggtaataacactgtttcttctattttttttttctttctttttgaaggcagctgaggaagttggatatccagtaatgatcaaggcctcagagggaggaggagggaagggaattagaaaagtcaacaatgcagatgacttccctaatctcttcagacaggtagagtataagctgtttttgtttgtttgaactaacatgtatatcagagatatatgatttaactcatactataatttggatgcccagaaaatatttaatttttaattttgtctatagctaactgtctttctctctagtttctacctgcatattagcagagaaaaaaggttaatgaaatgtccaactcaattttaagttttatttaattaggtaattcaaacagtagagttattctgtcttatataaacgtgctcagtttgtcagatagctctttcctacatggtgcgtatggcttataggacctcataatgacaaagaaaaatcaatacctttctgtatttttgtgcccctgttctgctgactttgtaggtcatatgtgatatggtggtatgatactgatatggttgctcttggcttggccaggcccaggctctctgattgactttttctcactttagttcacattgcctagagacctctgagtttctatcatatgtctcatctaccctgctgtcccagcactctataccctagcccgtgttgcatggccaccacaccctggcacaggaaccctatggcaggcctacagtatataggaactgagagtgactcaggaaagctcgatgtaggatctctctttgccttaccctctgctttgcagccaagttgatgtggccatactatacattggttgcggagacgaccaaagaagtgatgtctttttagaatcttaaacagaaagagaaaagggagacaggggtctctttttgttctgtcctcagagttaccctcacatatttaactcactttttttcctcctaccaatacatagtaaaagatttgtcaaaaaatggaaaattgggacagaagtctgctcttttcactctcctagcttccctctttttcatagtttcctcatcatcttctactttgcacttcttttactagtgtgccatgctaccttttatttcgctttttttttttttttttttcccttaaaacacttagcagcaaactccttgcttcactgttaagagttaaaaggaaagtcttatgagctgggtcttccatgatttcatatacaggtggtccccaacttaaaatttcaacttacaatcaacaaacaaacaactttacaatactgtgcaagtgataatgcattcagtataaatcttactttgagtgcccatacagctattgtttttcactttcagtacaacattcagtaaactacatgagatagtcaacactttattataatataggctttgtgttagaagattttgcccaactgtaggctaatgtgttttaagcacatttgaggtaggctagactaatctatggtgttcattaggttaggtatattaaatgcaattttgacttagaacattttcaacttatgttgggtttattgggacataaccttattgtaagtcaaagagcatctgtactagataaaggaagtgataaaggtgttgtcttggccaggattggtggcttatgcctataatcctagcactttgggagtctaaagcgggagcattgcctgaagccagaaatttgagatcagtctggaagataaagtgagactctatctctacaaaaaattgtaaaataaataaatcaataaataaggtattgttttgctacattatcctattttaagtgtcagaaattgaatattaccttgggttttttttttttttttttacatttttttcattgaattctaatttcataggtagatcagtgactcagagagtctagagaaaaaagactgctcttagaagcaaaaagaaaaaaaaggcatgttaattaatgttaactcttacagacatttcaaaactactcattacttatggaatcaaatagtggaaaagtcttaaaacactaagggaaggttttctgtgaaagtccttaagtttcaatactagttggctgaataaactaatcctcccattgggaacaaactagaaaagctgaaccagatatatatatatatatatatatatagatagatagatatagatatagatatattacattttacggcattagagaccattcaagacagtgaagaattatggggctaacatacaagagaaaaaggaaacccagagatgtgagcctgacatatgaggctacttttcccctagatatatcttctagttcaagatagtagaaaggctgataagttttcaacagtcttaaaagactaagagggcttcctggggaggggtgccctggaaaacctcccacattttaggttaggatctttaaggactgactacatcatgggagaaagggtgaactggaaatagactagccctcacagggactaaatcttggcttcaaaacattcaacctctgatttaagcaagatgttttaggattgctagtgcttctagacacctgcaggaagcaaatgtaaatcctttccagagaaagataacatccagaacttaaaattatttctattaatttttcttacagcttatcaaccactcaattgaaaataggcatacaaaattagatgattgaaaaccaagaagaacaaaacagtagaaacagacccacagagggtttatataatgagattatcagacaaggactttaaagtaattctgcgtaatatattcaaggaaagtaaaggcaagattgagaattttggtagagaactggaaatcataaagaagaaacaaaagttctagaactgaaaatgcaataactaaaattaagaagtcaatatcaggggttcaagaccagcctggccaacatgatgaaaccccatctctactaaaaatacaaaaattagctgggcctggtggcacatgcctgtaatcccagctacttgggtggctgaggtgggagaatcacttgaacccaggagacagaggctgcagtgagctgagattgtgccactgcactccagtctgggtgacagagcaagacattgtcttaaaaaaaaaaaaaaagaagaagaagaagaagtcaatataggagtttaaaattatagcatattagatgcagttgaagagaatcagtaactggcactggagactgagatgggagaatcccttgagcccaggagtttgaggctgccttgagctatggtcatgccactgcattccagcctgggtgacaaaacaaaaaaatctagaaaaagataaataattaacgactggtgagtagatcagaaggaaattcagactgaagcatgaagaaagacaaaaggatgaaaaacatagagcaatgtgagaaattatttgcaatggttttgtagttgttgctcttgctgtcttggagcaagccctcagactaccatgtgaagagcccattctagcctactagagaaggagaggtcacatgagcagagatgagttgtcccagctaaggcctcctagtcctactaggacagtcagcagcaccacatttgagacatgtaaatgagaccatatttgaccatctaaccccagttgagctgccagatgactatagctgcatgaattactccaggcaagatcagaactgccagttgtgcccagttcaaaatgctgatccacacactcatgagcaaataaaataaaatggttgctataccaagtcactaagattttggtagtttgttaggtatcaatggataattgacacagaaattgatacctaacggtatgatgttgccataacagaaaagtaaaacgtaagacattgactttaaaactggctcataggtgtaggctgaacattggtgaggaggatgttaatgaagactggaagaatgatgaattgttaagggaggctggaaaagcagtgtagtaattgttactggagtctggaaaaaagatccatgttctgtaataatggaacaattggcaaaaaaatgttatctgaggtaacttggaagacaaataatatatttaatgaagtcatggatctggttaaggagctctctacaagtgtttaaagtatctgtggagtgcttctagttgcttatgctaaaaaactgtaaaagagaggtaagctaaagaagatgttttgcttacaagcagaatttacagaaatgtaaaggacccagaacttgttgaaaatagaattgtttctcatcccgagtctctccagctggcaaaagatttgcaaagtaaaaaatgcctcagagtaaagaccaagtcaagagtgcctgtgactttaaggcctcagaaatctttaaggtagtagctaataaattaccctttcagctagaaagatgcttctaagtatcttttttttttttttaatgctttcagctggaaacatgcttctaactatctttttttttttgttttcttgagagggagtctcactctgtcgcccaggctggagtgcagtggcgcgatctcggctcactgcaacctccacctcccaggttcaagtgattctcctgtctcagcctcccgagtagttgggattacaggtgcccaccacaatgcctggctagtttttgtgttttgactagagatgaggtttcaccatgttgctcaggctggtctcgaactcctgacatcagatgatcctcccaccttggcctcccaaagtgctgggatcacagacataagccaccatgcctggccctaagtatcttaagggtactgtctcacagcatcctgacgtgcccaaagtatagagaggtctatgcagacatgagttgtggatgtgtctctttgggtgagcggtgaaccccaatatgattcataggaaacccacaaagttgtcaagagacttgtgttgatgaatgcaccaagggactgaaagggccagaaacagttcaaaatgaaaagtgacctctgagccttaaactttttaatgagcaggaagcagacagaaagctattcagctgtaaatagctgtcatttcaaataaaaagagggatttctcagagagtggagtcaggagcccagagggcagagctaggagcaggggatgccatggattaaggacctactcccagggaaccaaactagatcctgaaaaacaaaacaaaacaaaacaaaatgaaaagcattcctgaccctggagtaagggaatctgacagcatgtacctatctggatttcagaattgctatggaccaatgactactatgtacctcctatttcctcctctttgaacagcagtctcatttgcagttatcccctcccaatatcatcataaatattgggagtgttgggccagataacttgtcttcttagttcccaggtctttggatcaagagaaactgtacctgaggagttgcacccaaggaacctcattttcttctggacatgactcatgagaaaatggacgtcaagcccaatgccatgattggatgagactttgggggtcttgggagggggtgagtctgttttgcatgtgggaggtatgtgaattattgtggccatagggtagagcatagtaagttgtttgcaagagatggcgacaataactcctcccattcctgtatgtacaccctttgcaatgtgactttgctgttcctcccttccaggggtggcatctattttccctaccccttgaatcttagctggctttgtggcttgcttagaccattagaatgtggccaaagtgatgtataaattcgaaagcctagacctcaagaggccttacagcttcttcccctcttggaacacatcactgaagaagcctagtctagcctgctgcaggatgagaagccacctgcattggagatgaacgattccagctgaggctccctagacctaccagccagcagtcagcacaaatcaccagacatctgagtgagaccattctaccccactcaagctaccagatgatgatatgtatgtaagtgcaagaccagaagaagaactgcccagatgagaacaacatcataaaaggttgatgttctaagcaagccactgagttttgagatgacttgctacatggcaaaacagagcaaaaaagatacagagcataaaagacatatggttatgtgaaatggtctaacatcatgtactttaagtctcagaggagaagagaaagagaatggagcagaaacaataattgaagaaatgatgaagcagaagccatatttgaagagagaaaagctaagaatttctttgaacagataaaagataccaaggacagattcaaaaagcactatgagcctcaagcaagacaaatacaaagaaccacatctatgcttatcagagtaaatctaccaccctcccccctataaaagacagaaagagagaaaatcttaaaccagctgaggaataaagattactttcaaaatagtaacaataagattgacagttggcatctcagtagaaacagtgaaagctgaaaatcattgggattatttaaagtgctgagaaaaaaaatagttaccattttagaattctgtccccaacagtaatattcttcaaaactaaagatgaaagtcctttggctgcaacaataccatatatgatgtaatgtgaaccaggaaagtatcttgtctggaacaagttgtacatttggttgtacagagtacaggatggcagtattttgccctgttgttggatttgtgtatgtgcctatgttttcaaatattttgttgtttacctttgtgatgcaccagatgttcgtatgttttcatatttatcaattaatattggttatgtaagaatgcagcatcttaaagatattaaagatgacagcatggactgtattttattcagttttgtatttctgctgattaacatggttcctgacacttctggacatctgcttgttgaaatcaaagtagcttatcaagatagataaaaagtttaaaatttaagaattggttttttttttcccccttttctaatacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacaggtacatatattaaaaggcttactttatgttttcttacatagaacatttttcattcagttcatgtaccaatctgagaacaatggcattttaagcaacgattctgaataattaataaaattatatccttttcttagagaaaaaaaattctactgttctcccactaagagaattgtcaaggaacatgtcaagcttctaaaagtagttaacgctttctaaaaaaaatcagcgtaccatttcaggatacagggataaagaagagaaatgttttggaatttttaatcttatgattgatttttttaagaggctcataatcaggtagttttatttgctgggttgagtatcatcaagtcttcagctgaatttaatcaactctattatcgtttttggaaagtcctctaaatatcttcagagttcacacattctatctttttgtatagaaagtagtttctcaaagtcatgagcgatgccttcggaataactatagtttagaggcctgaacatagtcttttctggagtcctaacccagtctctacatcaaaatagattcttcaaaatatatttcatgtgtgttagaggtctatttcctatgttgtgtatatattaggatgtactcttgaactgctgtaataaagatgccttcaaaatacagtggcttggccgggcatggtggctcttgcctgtaatcctagcactttgggaggctaaggcggacagatcacttgagccctggaattcgagaccggcctgggcaatatggtgaaaccctatctctactaaaaatacaaaaattagctgagtgtcatggcacacgtctgtactctcagctgcttgggaggctgaggtgggaggatcacttgacactgggaggtcaaagctgcagtgagccttgatcatgctactgcactccaacctgggtgacagagcaagaccccatctcaaaacaaataaataaataagcaaaatacggtggcttaaacaaggtgtaagtttctatttctctttcatcatagttcagagatgagctgttaccagaaacaggtttattgctcacctgttgcctgtttttgtaaataaaattttgttggaacacaatgatgcttatttatttatgtgttatttatggctgctttatcactacaatggtagaattgaatagttgtgacagaggctatatggcccacaaaattgaaaataattactatctggctctttaccaaaaaagtttgccaaactttgctcttggacattgtcatcttcatgattaagctaactcacacaagattatgttcacattgtggcctgtgggaggaagagacaggggatgtggagggcaagcatatggaagcatgatcttgaagtcacatacatcacttctgctcacattccactggacaaaattcagttacacaattatacctagcacaaaggatgttaggaattgtgatcactaactgggtgaccatgtgctcagcaaaaatttcgattttattcctaaaatgatgaagtagagaaaagtcactggagggcatttcataatctgtgcctcagtctgttcctctggctacctattatccctttatcctttttcctactttcagagcacacatagcctttgtccaaggaagacaacctgaagccccatccagttactagtaactggatgggttattactggaggtgattccggatctctatatgatgtatattcttctccattagatatgtattgtggcttttcatgggccagtgactcaaaatacaagttatttacccagtattatatcccctgccttcaccatacacccatatacaatgatggaataggaacaggataactctcatttggaaaaatgaaaaatacatagcaatcgttggtccatagcagttatcaaatcctcctttttaggtaggaattgcaatgattccctgctatataatagaatactacctcagttagacctggctgtccctggttctgctactgcacactccagagaagtgcaataagggagtaaatcccttgttcattgtccttcaagacacctgacattgttttctgggaagttcttcctcattcagttttctctgtgagttgggctttggagactatgccttctttggcagaactttcacaacccacttcctgctggtgcaggattgagggcacaaatatcccaatcatcagtcgcaggcttttgaaggccaggtttgtggtttgtttagaaatacaattccttcaaatacttaactaagcttctgggctatttgcttgcaatcagctttgggttggattaatcatactcatagatttcttctagatatagaaacttttcttctattatttactggcttctgtgcttagcctatctctcttgccttgatttaatattggctatcttggggccagctgaaactaaagcagcacgtttgatctttgacactgagttgcttcagggtgataatctcattttctgtttggggggatacaaaagaagttggctttttcgacactctgaccctttcagaccatcttttttaaggtttagttggtgtgtggtcagtatcccaagttattgtaggaaacagtttaccaaatgttgtgttatcccaacaaggagattatcacctttccagcctgcagtatctgtttctctgctacccactacccttttgctaagctagcatctcatattttaatatttttaaacagcaacattctacctgcacttaataattcctgtatcgattaggatacaggttaaactgctataacaaaaaggtccaaaaaacacagcggacccccccaaaaatagaagtttatttttctctcccatcctagtctgaggtgagcttttcagggctggtggaagtgttttattccacgagaccatcttgggattcaggttcattctttcttttctttttctttcttttcttttcctttcttttcttggtgttcttagtgtgttctcatttgcatgattgaagttggcttatactatcatgactatgttccaatgaataagaaggaaaaagccaggaatagagaatgagacatttccttttcaaaatatgacttagggctgggtgctgtggctcacgcctataatcccagcactttaggaggctgaggtgggcggatcacctgagatcaagagttcgagaccagcctggccaacatgatgaaaacccatctctactaaagatataaaaattagcctgacatggtggcatgtgcctgtgatcccagctactcaggaggctgaggtaggagaatcacttgaatccgagaggcggaggttacagtgagccgagattgcgccactgtgctccatcctgggtgggtgacaaagcgagactccatctccaaaaaaaaaaaaatatatatatatatatatatatatatatatatatatgacttgggagttatgcatatcacttaccaatgctggtgtcctgtttgtcaaaacttagccactaaccaggccaggcatggtggctcacgcctgtaatcccagcactttggtaggccaaggcgagtagatcacttgaggtcaggagtttgagaccaggctggccaacatggggaaaccccatctctaccaaaaatacaaaaattagccaggcatggtggcgcatgcctgtaatctcagctacttggggggctgaggcaggagaatcacttgaacccgggaggcagagtttgcagtgagccacgagattgtgccactggactccagcccaggagacagagtgagactctgtctcaaaaaaaaaaaaaaaaatctagtctctaactagttagctatgtttctagaaagaagaggagcatattggaaatactggaaactggacaagagtctgtccccatgtttttttgtctgcatgcatttatgtctggtggggtgaggttgcttttgatgcaaagtgaaaaatgctcttttctcccgatttttcattgagtttttcatccttgtccagggatattgtataataatcagaaatgtgctctcatgtggctaaaagcttttgatggctcttatacacactgaacagttgagtcagtgagaggctgtagtggtctagcagttggataaggtgagatacttatgtttgcttatctctcttctttgagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccaggtgagtctccctgatctgggttgcagagcctagaaaagtcagagaggcctgaaaaatgggtttaaccagtgtgtgataagagaaaagcacctcctatctgagtcacacctaatggtcatttctctttcaccctgtatgtgttatgcatgtgtggtttggttttcctgatgtagtacagacataggaatgttattttttctagccagacacatctgatataatgtgtcatgttttagaaataaatgttaataatgtatgctttattcaattatttagctatagtaaacttcacaactttgtattataattattccctactcatttttgtttttttactagtgttctttattgaaataattctgcatcagagattagtggttgaagtttttccttacaagagtgtggtagcacacatatatttttataatttgtaaagtgcttgctgtcaatattattgtcttctctcagcccaggaaacaaatattatggaaagcagtaatagttaatgataaggcttgatattatttttatctaacatttgcccacatcgagaacaccttctgggttcctattaaagactaaagatttacttacttcctccagtggtttgcagggatggaagagataattatgacacaattaagactttctagctgtctgtttttggatggctattaacatttactcctctgttggatattttcattcttattacgtgatggagaaatgacaacaggggaactggtgtctgttgcattaggaatgtggggacttctttagaagtggagaatattctaactacttatctgtagtgatatattgtatttcaagcaacttagagttgatgattgtagaatacaggttataaaaatagaatgttttagggagtggctccaaaaataaaaatattttaggttatctgatagcctctacactttaagggaagtaactgaaaaattaaagatgtgtgttttattacctttcagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgaggtaacccatcacttaaaaggtttatacctccttttaatgaactttaatgttaagatagtatctgaaagtatacttctgaaatatcttgggacttcctctggagtgggaaacatagaggtttctcagagcagataagtaaatggttgttgcttcattggttacttaatcccacttaagtcactgtagagtcttcagtgggtctgtggcactgggtcttggcctttatcatttttgtgtgtcttctctgcttctgtgtgtgattaacagagaacttaaacaatgaatatataaatcttctcttccttcgaaacataatatggtctctcattctttattctctaacagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcgtgagtataatagcatttgattgcattttacaaaataaatttgtgctaatcttaagtgaaggtgtgagcatgggaataggaatcatctgctgtcaaagtaataatatgaacaacctttttgaagaaattttgaatatctttaattacacttgcattcatgttgtattaaattatgcagtgcttggcagatgtttttctgtttgttgttctgagccttttgaagtatttttcctttcaaatatttttgataaatgtataaaattgattgctttaaaggtatcttatttttccacaggaacagtattgttattgaggggaggtagattcttggccaagaactaggtatcaaataaatcatagacttttattttatttttttcttgtgagaagacttaaaatctattagcaattttcaagtacacaatctattgttatgagccatagtcaccatgatgtactcttatagttatttaaaataataaaattatactgctcatattatgaaaaggacataaagaaactgtctacattgctaatacaagagaccttagcatgctgtatataacagcttatgcaaatataactgctatatcataaatgttagataatattctattaatcataaacaatgaatattaaattaacagcacttttgcttgcctaaaacatagggctgaaggaggtaattttaacagcttagatcttttggaatatctatctaaaattgaaacttgaactagttcttttctgttttttaatggtttattgccttgtatcaaacatttaataccattccctttacctttgtactgtacatggagtaggtaattaataagtgtttattagtattaattactaataaatagcatttgtttattagtaattaatcctaatatatggttgtttgtattaataaacacttattgattagttttatatttttatcaatttcctgaattaattaattttaagaggcagagtcttgctctgtcacccaggctggaatgcagtggtgccatcatagctcactgaaacctcgacctcctgggctcaagcaatccttttgcctcagcctcttgaattgctgggactgcaggtgtgcaccatcatgtccagcaaattttaaattttttgtagagatggggtctccctttgttgcccaggctagtcttaaactcctgggctctaatggccccacaaagtgctggtattataggcatgagccgctgcacccagccttgattaattagtttttaatattatttttagaagtagggaaatctcattatttctctattttgtcctttacatttcttctcattcttcaaaactataagtggaatttttcaaaattaaaacactgctaccagaaaaaaacattggtatgaagttgccttttaagcatattcgctgccatattatgctctgcaaagtgaaaaaggtttacactagagcttgcaaattgttggctttctggtgagtctcaacatacagatgtgttttgatgggctcacaaagtgttaattttttttaatttgacaatattaaaaaatcaggagattgaaatcaaaatatggatttctgctagctcttaaaagtaggactataatgacaacattggttgtacattctagttgttaaaagttagctaattttgcctgggcacggtggctcacacctgtaatcacagcactttgggagaccgaggctggcagatcacttaaggtcaggagtttgagaccaacttcgccaacatggtaaaaccccgtctctgctaaaaatacaaaaattagccaggtgtggtggcaactgcctgtaatcccagctactcgggaagctgaggcaggagaatcactggaacccaggaggctgaggttgcagtgagccaagatcacgccattgcactccagcctgggcaacaagagcaaaactccgtctcaaaaaaacaaaaaacaaacaaacaaacaaaaaacagctagttttgtgtgactgcttcttttcgacgggacataaactttgtagttaacacagctcctattcagtctgcctcactcatttatgttcccagactggcctctgttggcatttaggtttaagtcctgatttggcagaccactgtgtattttcttcagggaatgtcctataacccaatccagaagccttgttccttatttctgaccagctctgtacatttgtctacagtacaaagctaactagcttaatttttagcatgttaaaaatacgttatctacaataagtctccttcttgacactatgccaaaagttcattcttcagcttagagctttctttgtttcttatttcttcatttcattaggtctatatctcagcttggggtttggactcttgtttgccagaatgccccaactcatatattccagtatattccagtataatttcccatgggtcataatctaaataccatgagaacaggactgtgtcttgttgctgctatatcccctgaacatagtaagcattcagtaaacgttggttgaatggattagccactcattcctatccttatacctctgcttcaatcataccattccctgaactcaagctgtattttccttttttttttttgagacagagtcttgctctgtcgcccaagctggagtgcagtggcacgatctcagctcactgcaacctcttcctcctgggttcaagtgattctcctgcctcagcttcctgagtaactgggattacaggcacgtgccaccatgcctggctaattttgtcaacctgtattttcttccctctgcttctttgttcttgctatttcctctgttcattcatttattcttttttttttttttctgacatggagtgcccgccaccacacccagctagtttttgtatttgtagtagagacgggtttcaccatgtcggccaggctggtctcgaattcctgacctcgagtgatctgcccaactcggcctcccaaagtgctgggataacaggtgtgagccactgtgccaggcccattcattcattgtattcaacaaatatttactgagtatctgctatctactggttctggcaatacagtgaggtccaagatagaatctctctcctcacaaaactttacaatccagagggtgtaagacaattggcagttaaaatacaatgtattaagtatgatgatagtcagattatttaagggcattataggatcatacagatgagtcaactaactcagtctagaggggttctgggaaggtatcccagaagacagtgacatctagattgataattgaagtttgtagaagtaagtcaggtcaaaggaggacacagaaaggaggacagaggtgggcaacagaataatattttaggctgagggaatgcctggactacctggaatatgattcctctcacagttataattatcagctatactttagcccatgtcagtttccacatttttcatgaaactgtagggagatgaatttctcccttcttacaacctctccagaactttgtgtaagtattctgtctggcattgatgatattctgccatatattttgaaagtgattattgtatttatgttcttccttacaatcatagtatgtgtcttattagtatgaggtacataattagtatttgtggaagtaagtacctgtcccatgcaggatagacactgggcataaatatacagaaaagccccatagtatttgaaattctgctaaaattggatcactttgcacttaactgggaagtaataaaagtaatgagcaaatcattgcatagatatccaaaatgcagttttaaaaaaaacactgtcacatgcagtgtcaggctgatatatgactgcacccagagagttgctttactgtatggaaatctttaaattaagcacttgggaaaattcattgaactgtatacttaaaataagtatattttattgtatgtaaattatacataaaataaataaggtacaaggatagggagaattaatgccctaattcttgttagccaacaacaaatgaatggaataatggaaacttagtaagtaaaagctgagggtgacttgcatataatttgttataatttgttctgtactcattataatgaaatgtttctgatttgctgatgctcttatggtaatatcagttagaattcatacgttttctgactttttgcaaatttccctctcttgaatgcacatgaatgagcacacttgacatgtgcacccttatttgtttttggaactgcctctctcccttccctctcaagattccaaaggaatgaaacagttctttcttttatttttatttttatttttttggggggacagagtctcgctctgtcgcccaggctagagtgcagtggcgtgatctctgctcactgcaagctccgcctcccgggttcacgccattctcctgcctcagcctcccgagtagctgggactacaggcgcccgccaccacgcctggctaattttttgtatttttagtagagacagggtctcaccgtgttagccaggatggtctcaatctcctgacttcgtgatccgccttgtcttggcctcccaaagtgttaggattacaggcgtgagccaccatgcctggccaaacagatctttaaaattattgaaaaacattaaagtgtttgttgctgaaacagattggcttctgttctcccagaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggtgtgtatttctccacaaacagatgctgggattgggtttttatagacttgtgtactcaatccctgccactacatgaaatttatttgattctaatgtaaatggttcttgatctacctggaaaaatctaggagtcagtgtaattttagcactctgatggttcctgtgcttgtgtcacacagtcattttatgttctagcattacttcctgaggtatatttgaagtgaggcatgcagggatttaattactttctttttcttcatttaatgttaaacctggtccatagttgccaacttctgtatctaccagatgctgaagagagaggcctcatttagatcaagagttatcacttattccttaattcctggggctatgctaaattatccaagattttgtataaaatcgttagattcatataatttggaggtccaaattttggctatacaccgtttttctttgagattatcagtagccaaatcgttgtgtctttttaaatttatttctgtcagaagcctatttttgagctattcaatgattggctaagtggaagtcttagggagaaaagaagaaagttgtttttcatttctcttcaagtggtgcctctaatcaaattctaaaagtgaatgtgttcatttttatctaaaaaatcagttgggcagtgagaatggagattttcattgctagctgtttcatcacaacaaatttgagcctgatttcatttgagaggctgtggtgccaagtgaccatgcatttgatctgccctctttttcctcctttcaggctgagcgacctgacaccatgttgggggttgtgtgtggtgccctccacgtggcagatgtgagcctgcggaatagcgtctctaacttccttcactccttagaaaggtaggctttgtttcttgtaggctacacaaactaatcaatggccctgagtacagggactgaagctcaaagacccatttattcttctgtccattcctggcagcttatgagtgctacttgttattcatggaccatggtggcaagaaagagaggggatgttgacatttatggcaaattatttggggagtcaaactgcagattctagacattaacttataccacagttagaacaggttgcttctttaaaaactggaatccatctgcagtagatattctgtcctgtataagtatcaaatctctccaaaccctggtgataaaaatctggtatttctccctagcactgaaccctaaatatttcatgtattacttgtaccacctttcagaagtaaataattaaggctgatattcaggatgacctcatgagtctttcaagtagagggtcagacatctatggggctaaactaatttctattgctgattgaggagactaagctctgcctttgagtccccagaggaatgttccaagtggctaatcattttaaagcactttaatcacaggcacttttatttccttctgtgttgttagacttatatcaactcccttttgaggtatctgaaagaaagaaaagaaacaaaatttaaaaattgaactgagatttcagagttattcaagtcctatgataagtatctttcactatgttactctcatgtagtaaaaccttcagcagcttggcatttctcttctgtatcaaatctaaatcccttggcgtgactttcaactccctgtatacatgggccgctttttaccaatccagtcttatttatttctgttctgcaacatataatctgtaacctagttaaatagttttcttattggtgtacaaatatgtcaaatgcattttcctctacaagccccccacccacctccttttaaaatgcttttgttttttacttattttattatttttattttttttatctttgagacagagtctcgcactgatgcccaggctggagtgcagtggcgcaatctcggctcgctgcaaggtccgcctctcgggttcacgccattctcctgcctcagcctctcgagtagctgggactacaggcacctgccaccaggcccggctaattttttttgtatttttattagagacagggtttcaccgtgttagccaggatggtctcaatctcctgaccttgtgatccacccgccttggcctcccaaagtgctgggattacaggcgtgagccaccgtgcccggctgcccggcctttttaaagactctcaaataaagtttcagttgctaggagcagatatgcttacactgaagttttataattttttcgcgtttaatcttaatctttttttttgagatggagccttgctctgtcaccaggctggagtgcagtggcgtgatctctgctcactgtaaccttcgcctcctgggttcaagggattctcctgcctcagccacatgagtagctgggactacaggcacgcaccaccacgcccagctcatttttgtatttttagtagagacggagtttcaacatgttggccaggatggtctcgatctcttgacctcgtgatctgcctgctttggcctcccaaatagctggaattagaggcgtgagccactgcgcccaaccttaatctttatctttaagaacagttaacacattcatgtggttcaaaattcaaaaggcacaaaaaagataagcagtgagaagtctctctcttacctctgttccttggccatccagtttccgtcccctatagtaaattcatattaccaatttcttttctaaccttccaaagataccctaaacttacatgaacatatatatgtgtattagtctgttctcacactgctaataaagacattcccaagactggctaatttataaaggaaagaagtttaattgagtcacagttccagatggctggggaggcctcacaatcatggcggaaggcaaaggaagagcaaagacacatctttcgtggtggcagccaagagagaaaatgagagccaagtgaaaggggtttccccttataaaatgatcagctctcgtgagacttattcactaccatgagaacagtatgggggaaccgcccccatgattcaagtatctcccactgggtccgtcccacaccacaagagaattatgggagctacagttcaagatgagatttgagtgggaacacagccgaaccatatcaacatgcaatatttgtttcttcccacctcctggttttttaaaactcaaatggtagcatgctgtgaagctgttatttaccttgcttttttaactcaacagtatattttttaaagtgttttttagttcacatctttttaatgtctgtatgttttgttccacatgtgaaaacatgcgcaacatcactaatcattaagtaaataaaatcaaaaccatgatgagataccacctcacacccattaggatgcccactgtcaaaaaacagaaaatagcaagtattggcaagtacgtagagaaattgggacacttgtgcactcttgatgggaatgtaaaatgatgcagccactattgaaaaatggtattgcaattactgaaaaaattaaaaatagaattaccctatgatctggtaataccacttctgggtattctgaaagaattgaaagcagggtctgaaagatacttgcacagccacattcataggaggattattcacagtagctaaaagatgggagcaactcagatgttggttgatggatgactggataaacaaaatgtggcatatacatacaatacagtattattcagccttaaagaagaaggaaattctgacacatgctaaaacataggtggatcttaaggacattagggcaagtgaattaagcctgtcacaaaaagacaaatactatatggttttacttatatgaagtatgaagagtagtcagactcatagaactagaaagtagaatgacggttaccaggaactggggggagggcgaaattgggagttgttaatgggtgtagagtttcacttttgccagttgaaaaagtcctgcagattggttgcagaatagtgttaatatccccaacactatagaactgtgcattttgtaatggttaagatggcaaatttaatgtaatgtgtattttaccctaatttaaaaaaatccattgtaagattcataattgatgtgatcaattccttacaaacgatcatttaggtatttaggttgtttctagtcttttgttattctaggaaatgctacaatcaataatgttttagattctcttataactgttagaactttgtagtaagttcctctctcatcgttctttcaggggtcaagtccttcctgctcatacacttctgaatacagtagatgttgaacttatctatgagggagtcaagtatgtacttaaggtatgcagaaccccattggagcttgcaccttacttttttagctatctttctttaggttgagaggcaggagaaaaagtttgatttaatgcagggatgggggtattagtgaaattaccgtcattatttttgtcagtgtcctgaagcagcgtttgttgttctatgaaaatcttttttgttgttcttcaacttcacatacactgccaagagataaaggagagacagggaacaaccacagttggggaaaatcaactaaggttgccctctttgcttacagcaggactgagccatgtccacagacactgatgcaaatagcatcagtgccatgaattttcttcctcctgacagatctttcttatctgtatttttgaagcattcaaatttcatttggagctgtacctggaagggacacactgatcctcattctcattccctacaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggataggtaagtggctgtttgaggtccatttgctggtcatcctgttagccttttctcttattagctactagctcttgggattttcccaggcttttcttggtactcatttgtagttaaaaaaaaaaaaaatagtacatgcacttaacaaaaatatcaagagtattaaagtgtttataattaaaaacatgtctccctaccactccagtgtatgtggacaatgaaaaataagttcccctttttataagtaaccattgttaaaagtttcttacatatttgagtagaaattttatatgcatatacaagttacactcatgtacatactgtttttctttaaatacattcacaaatgtggctgggcgcggtggctcacgcctgtaatcccagcactttgggaggccgaggcaggtggatcacctgaggctgggagttcaagaccggtgtggccaatgtggtgaaaccctgtctctactaaaaatacaaaattaaccagatgtggtggcttatgcctgtagtcccagctacttgggaggcagaggcaggagaatcacgtgaacctgggaggtggaggttgcggtgagccgagatcacgccattgcactccagtctgggcaacaagagcaaaactccgtatcaaaaaaaaaaaaaaaaaagaaattcacaaatgttcaacaccagttatggtgttatgagaatgaaataaattaacatgttgaaaatgtgtagaacattgccacaacatagctaggcttcaagaaatgttagctattacgtcatcaatatctttgtgtgtgtttttttaaatggtggtacctgttatttttaatagtcatgtggtattccattatatgattatactatatttaatctgatccttattgaaggaaatttatgttaattgacattgtaaacaaatatgcagtgaatatgtctgtgtgtgtgtataataaagttttcaggattttttttctttgaaggttgacattctctaccattctcctttacatcctgaggtgctttcttagcttacatacttccacttgtctcctagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtcagggtggtgaaaggactgtgggatcatgggaggggaaggtaggaaaagggtcggctgggatggactaggactgaaaagttacagaaaggaggctgggcacagtggcttgtgcctgtaatcctaccactttgggaggctgaggcaggaagatcgcttgagcccaggagttcgagactagcctgggcaagatggtgagaccccatctctatgaaaaattaaaaaattagcggcgtacagtggcacatgcctgtagacccagccactctggtgtctaaggcgggaggatcccttgagcccaggaattcaaggcagcagtgaatggagattgtaccactgtactggagtggtacaatttgtggcctgcgtcacaaatcaagaccctatttctaaaaaattaaaaaaaaaggtaacagattggaaataagaatgaaaaagaaacatcagttggcttaattagaagtgcgaaccttaagatttttaaaacacataggcaaatgaggaatctctagttctaaaaatagatactaggcaatagcacttgttgaatgttaggtgtcctaactgctggctatccagagaaaatacatggaggtggggcacaaaacagacaagaaatgtcatgtgattaattttaagagagctaagcatagagtgcagagggtcacctaacccaaatcaagctaagcttgtatgggaagatattctgaaagaagagacatttgatcttagttttgaaagacagatagtgatagagcaggtgaagaagggcagggaagagtgcttaaagttgaaggaatagcatgtacaaagacagaagcaagacagcacagtgtatttagggaactgcaagtatgtgttggtgtggcttgagaatagactaaggtttaatggggagggacaagcaaaggtgctaaagaagtaatgtgagatcttgaatgtgaggttatgaaggatcttataaaccatactagtaagttttcactatcctggaggcagcaggtaatctctgaaagatttaagtggaaaagtagtatgatgagatttggggtctaggaagattgcttttcgtgaccttgagggaggtatgtagcaagtagggagatctcttagggggtctttgaagtactttgggccagaaatgaagaaggcgtaaaccgaagagatggcaagagaggaagatttttgagaaaggtttagaagatatgtctggctgggttggtaattggtaggtaagggagaaagaggagtgaagaatgatccttaggttttggcctggttgtcttagattggattcactggtatgaggatattaaattgttccttactttctaagtacaaaacaaatataatcacaaattatgccaaaatggttgtaaaagttagaaaggagaaatgtcaataactgttattaattcctaaagtgaggtactgagagattttctaattgcttgccttgatagtccctaggagatgatggtaaattcccattttttcttggtcaaattaggtgtggtccaacttagatgctaagggaaaaattttagttcttttaagcactcatctgtgtaaagagagataaatctgagtctagtttatttttcactataggtaatgaagatggtaatgaccttaacagctgtggagtctggctgtatccattacgtcaagcgacctggagcagctcttgaccctggctgtgtactagccaaaatgcaactggacaaccccagcaaggttcagcaggtgagtaggaaggtgctccgaatattgctctctaagagctaaagaacttggtggtttggagaggcaagtgatttcaatgcttggtttgccagtgttttctttagctttgtcccctattaatcttatgccttgtatttgtgcctgtagtattatggaactagagtttgcaagagttactgtagtactaagattctgtaatttccttatgatgtttcctctattgacttccctcctggtagctgggtatgatgtctcgattttgaatgataactcttaagtgcagtggtgtgtttgtaccttagatcaaaagtagtagatgacttgatctcttgttggggttgacaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtatgtatcacgtctcctggggaagggatgtacaaatgggatacctattctccaaaatagttccaagtctcataatgattgtttaagagggaggaaaagaaagctgtttggcctagaactctttcaccttcagttgtgggacttgaggtctttaaatccatgtttcttatccttgtcatggacttcacatttaattgtggttactcctttttttttttcctcgagacggagtcttgctctgttgcccaggctggagtgcaatggcacaaactcagctgactgcaacctccacctcctgggttcaagtgattctcctgcctcaacctcctgagtagtggggattgtaggcacgtgccaccaggcgcggctaattttttttttttttttttagtagaggtggggtttcaccacgttggccagactggtcttgaactcctgactttgtgatctgcccgcctcggcctcccaaagtgctgggattataggcgtgagccactgtgcccacccgtgattagtcctttttaaactggagaataggggcaatgttagatgcttacgttgcaatttcaaagtactctatgatagttggctcacgcctgtaatctcaccactttgggaagctgagatggaaagatcgcttgaggccaggagtttgagaccagcctgatcaacatagcaagaccccatatctattgaaaattatataaatttttattgaaaagaagtagtatatgatagtgaattcagatatagttgactcttgaacaatacaggtttgaactgtgtgggtccacttatatgtggattttttcagccaaacatggatcaaaattacagtattgatgagatatggaacccacaactatttctatacatgggttccgtagggctcaagtatgtgcagattttcatatatgagtggtggttctggaaccaatttcccacgtatacagaatgacaactatatatctttttatttgggggattgtgttaacttgggtcctattttaccaatgctttctttctaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcaggtatttataggataacactatatttttttctggctaccaatgccagagtttatgttgtaggattccttcctatttggatcctccttactttttggatgttgtgcttgtatacttttaagcattgtattcctcacaaaactgcctcagggtacaaacccaacagtgaaagtactgtatgtgaaggataagtatctgtagttatgagaaaagcacacttggatcatgtataccttatagctttgttcctggggctattccctaattagaggtattttcatgaattgaaaatagagtgatattagttgattgattgattcattcattcactcattgatttagagatggagtctagctctgtcaccaggctggagtgcagtggctgatctcggctcactgcaacctctgcctcccgagttcaagcaattctcctgcctcagcctcctgagtagctgggattacattcacacgctgccatgccagctaatttttgcatttttagtagtcacgggtttcaccatgttggccaggatggtctcgatctcctgacctcgtgatccgcccacctcggcctcccaaagtgctgggattacaggcgtgagccaccatgcccagctgtttatttatttatttatttatttttgagacagggtcttgctctgtcgccaaggctggagtgcagtggtgcggtcatggctcgctgtagccttgaccccataggcccaatggctcatcccacctcagtctcccaggtagctgggactacagatgtgcaccactatgcccagctaatttttaaaaaatttttatagagatgggggtctcgttatgttgcccaggttggtattgaactcatgggctcaagctatcctccctccttggcctcccaaagtgctgaggttacaggtgtgagccaccacacatggcctattggtagttttattttcagagacattcttactaccttggcagcatctttactctttacccataaagcagatgtatgtgtagggaatataggtagataagtggggagtgatgtttggatcttgaccttgaacagatattggtaagatgatagtttttgtaatgtagtcattaattcatctgggaaagggtgacaagggatgaaatctgcttgcttatgtagcgtgattctctatatagactacgcctggtaacttccagctgctgccaacatgtgagataggaactgccatgttataagaagaagattcctactggtcgtgctatagaggctgatgctttggggcattttgttgggttgggcctcatttttttcccttttttataccttagattgcaaacatcctagatagccatgcagctacattgaaccggaaatctgaacgggaagtcttctttatgaatactcagagcattgttcagctggtacagaggtagtaacttgtaactccagattcccagacctgtccatactcatgtcttcctttctttcaagtggtcacaaaaaaatttacctcagatttgacttcaagaaattggaaagcatcttatatcttagaaagtaccttgtcttttctaaatatcttagaattgtgagctaactctcatgctcaatatttctgacttcttaatattctacatttttttctgtcaattatttattattattattattttttgagacaggatctcactctgttgccccgactggagtgcagtggctcaatcatggctcattgcagcctcaacctcctgaggctcaggtgatcctcctgtttcaacccctctgaatagctgggactatagctgtgcaccaccacatccagctaatttttgtatttttagaagagctggggttttgccatgttgcccaggctcatctcaaactcttgggctcaaatgacccacccgcctcggcctcccaaactgttgggattacaggcatgagccactgcgtccagcctgtcaattaataaggcacagaaattttgttgttttctttttccttgccattttgatgaagctcctaatttttcttctgtcacagggcccagtatgacattttttcttcttagcttatggagcctattatattaggttggtgcaaaagtaattgtggttgttgctattaatactaaagggatattcacagagcatatttatttatttatttatttatttattttttttggagacagggtctcacactgtcatccaggttgtagtacagtagcacaatctcagctcactgcaacctctgcctcccaggctcaagcaatcctcccacctcagcctcttgagtagctgggactacagtcacatgctaccatgcttggctaatttttttgtattttttgtagataagaggttttgccatattgcctaggctggtctggagctcctagactcaagtgatcctcctgccttggcctcccaaagttctgggattgcagatgtgagctaaggcaaccggcctcacagaacacttttaactttaagatacttataaatttttcagatatctcagccatttcaagagtatggtaataatttctacttagcagtaggaactgaatcaaggtgttggtaggtggggctatgcaggattttgttgtcttctttattaaaaaaggtcttgtctatagtgagatttcttttaggcttagaatttaagttaattttgtagttcattttaggctgttctttattcagagggaaagcagttcagtggaatgtcgtggaggtaaatttggcctttgggtttattgcttaatagtgttggattgtcaggtttttcagtggagactttctatttgcctaggtaccgaagtggcatccgaggccacatgaaggctgtggtgatggatctgctccggcagtacctgcgagtagagacacaattccagaatggtaagcctcttcctgaggactctctagctaagaaagccttgattctgataaccaacccaaactatccctataggactgtgtaagagctaagccccctcctgtcaacaacacttcccattaataaacagtctcctatcactactcccttaaaaactaaacctctatatccactagctctaaagaaagaacaacgaaacacagcttgatgaaattaggaatccagtgtgcttctgagaaagggctgaagtaatttttctaatagagattaccattcctgttgatatctttttgaccttgtgtagtgtaagttggttgagtcatcacaggctgaaattgagaaacccatatctgaagagcttgattcttggcagctaatccatgaattgaaccagaggcatctaggaagagcaagttcaggttttccaatactttttagtatatcatttaggtagactttatccctggctttctctgaagagcttcactaaatgataaattgtctcttaagtgtgaaataaccttggctaaaattttaaagctgtttactgctgacattgcttcctgccacaagatggcagtgaaacatcacagaatttgaaacattatctgaaatttgaaacattttcctttatctgctccttttcacttcctttaaaagcagcctatgccactcatgaccagcaaaaatcctcatgtagatatcagcaaaccgcatccaataacatacaaaataatacataacaaccaagttggctttatcccacgcattcaaggttgatcagtttggagaaagtcaattaatataatttatcatgaaatagatgaaaggaggaaaaacatgctcattatctcaagataacagggtgtggagagggagcatttgacagaatttaacatccattcatgacaaactcttggaaactaggagtgaaatggaacttttaaaatcttgtaaaagggacccacaaaaaaatctgcaggatacatcatgcattatggtaaaacgttgaaaacattatctttaagattaggaataagacaaggatgcctgctgtcactacttctattcagctttatagtggatgtcctagccagtgcagtaagacaaggaaaagaattaaagggtataagagctagaaagtaataaagcaatatatctgccattattaaatatgatagggtgtctctttagaaagcctcaaaggattcacagattgattattaaattatttaaaatctaacatgattgctaaatacaaaagtcaacatacaaaattcaacagtatttgtttacagtagagcaattgtttagaaaagcagttcaggaaaaaaaaaattaaaatagcaggctagatgtagtggctcatgcttgtcatcttagcactttgggaggccaggacaggaggattgcttgaggccaggagtttgagaccagccttggcaatatagtgagaccccatctctacaaaaaattaaaaacaattagccaggcatgatggcacatgcctatagtcctacctactcaagaggctgaaacaagaggattgcctgagcccagggattcaagggtgcagtgagctatgattgtaccactgcactcagcccaggcaacagagcaagaccctgtctctaaataattaattaattagttgataaaatagcaacccaaaacatgaaatactaaggagtaaatctaacaaaaaatgtgcaagcctcttttgaggaaaattataatcaagaatattataatagtaaagaagatttaaataaattatcaaggtcttaaattggaatgtacactattaggtgccgattcttcctaaattcatctgtagattgacatttcaataaaaattctgttagtgtatttgtaatgctaattataaaatttccataaaagacaagtctcacaataaccaagatacttccaaagaaatacaaggtgaaaagatttgcctaatcagatatcaagatttaatataaagccatattaattaagaaattgtgagataggtgtagagatagatttatagatcagtggaacttaatgacccagaaacagatccagccatatatgaaaacttattttatgatagaggaggcattgtagatcatggggaaaggatagatttttttttttttcaataaatgataccagcacaatgggttattcatttaaaaaaaaaaaaagaggaaagaaagaaatggaatccctatcttatgcctatacacaaaaatcaattcccgataaagacttaaatatgtactaaagaggtgaagctgttaaatggttaggagaatatcgttataacctcaggataggaagattttgttgtataagacacagcaagtacaaactacaaaagaaaagattgattacttaaactccactcaagaacttctgttcatcaaaatacgtcataaggagtctgaaaagcctgtaatcctagcactttcggaggccaaggccggcagattgcttgagcccaggagttcgagaccagcctgggcaacatagcaagaccccgtctctaaaaaaatacaaaaattagccaggtgtagtgttatgtgcctgtagtcctagcttcttgggaggctcaggttggaggattgcctgagcctggggaggtcgaggctgtagtgagctgtgattgcatcactgcactccagccccgttgacagagcaggacacagtctccaaaaaaagagactgaaaatataagctacaaagtgtgagaagatatttacaaaatatatacctaaaaaataattagaagtatctagagaattggtatgaatcatcaagttaaagacatcctaatagagaaatgggcaaaagatatagaaagatattttacagaagaagaagtacaaataatttataaacttacacaaagatgctcaatcccatttgtaattagaggcatataaaccaaaaccacaatgagagtggcaaaaatttaaaagtcacatcatcatcttcattgcttctgtacatggaagtacaaattggtatataccactttggtaacagttggtcagtacctaataaagttgaacttatttgtattctttaacctagtaattttactcctagaaaatatactttagagaaactattacacatgtttactaggatacatatacaggagtatttgtgacagcactgttcataatcttaaaaaagacaagaaacaatctaaatatacataggtagagtggatcattgaagtctggtatattcctaccatggattactatgcagcagtgaaaatggatgcaccaaggcatacactgaacaaaaggatgaatctcaaaaatacaatgttaaggaaaagaaatggtacagtgattccatttttttcaggttcaaaaaccaggaaaattaagctatacatacattggtgataaaagttaagaaaaacaaaagaataattaacataaaattcagcttagtagttgtttctgaggaggggtacgcaggggtcttcaaagatactagagatgttctattaaaatgtaatggctttaaaataacacatgggtgtttatttcaactgataccatatattctatatattcttctgtatatatatttcataattaaactgttttgttttgttttttgtttggtgtgtgttctttttttgttgagatgaagtctcactctgacacccaagctggagtgcagtggtgcaatctctgctcactgcaacttctgcctcctgggttcaagcaattcttctgcctcagcctgctgtgtagctgggattataggtgtgtaccaccatgcctggctaatttttgtatttttagtagagatggggtttcaccctgttggccagcctggtctcaaatgtctgacctcaagtgatccacccgccttggctgcccaaagtgctgggattacaagggtgagccaccgcacccagccaattaagtgtttttaaaaaagagtgtcttggtatgcaggatcttcaaagtaaaaaaaaaaaaaacaagaaagtatcattgctttctttctgttaatgtctcccctcaccccgggtaaatgtgttctttttatttcccctggtcctattgccaaagtttatttgtgttgtcacttcaaagctaagtcttggtagagaaaaatattaatgcagaacagctaatttttaaacagcttcccttttggtctaaatgtgtcttttatgaaattggcagctctctcgatattgtagtccattgtttttcaaatataattttatttggaaaaaaattgcttatgtcaatctctaatatttagaataattaaaagcctggttacactggtccagtgtactcagtgttctaggaaaccatgataatgcagtttgaacgtcactgttctggtttgtaacttaacgtggaatctgaactgaggtgataatcctttactgttttcatgatttcataaaattctgacccttgagaatattcaaacactaattcctctttacttggaaatttaattctgaggtaagctgttttctaaagaactgaatattacttatatcccatggcagatatcactacagtgtaccagaggcttatgcttctgttgtaaaacatagctttcctactcagaactaacctgcccctggtggccttagggaaggcaagtgaaaatatgcataactttagtctccctacagaccttttgacttaatgcaaggttctccttgatctataccttgggttggatttggcgttcctaggcattgcttagctgtttcaaggactaacagaagaaaatgttgattccaggggtagcagtcacacttctcatggatattgctaagtttggtgtggttttattttttgagctaaaactgttcctactgattagggtcaactattttctgcaagtcaaacatggaatcagaatctcaagctctgggggagaccttaaagatcatcaagtttaatgatatttacatttctttttaaacagaaatttctcgtctaaagaaatcatgagagagtttagagtaagactggggtttgagttattcccaatctttcagtctttaaggtacacccacctccccaatttttaaaaaatttaatgaaattgaggcccagagaggtaaaatgattttcccaggagcacacagtaaattgctaatagaactaggccttgaacccagatcttatatccaaattgcctgactcctagtccagtgttccttttactaaatcacattgccagtttctgtacaaatccatccaagaaaatccttatgatgtttcttctcactgctcgtctcataaattatagacagtacaaaacaaatagcatgtaaatgtgaacatttatacatgggtgagaaccagttcttttcatggtgtgcaggtcactatgacaaatgtgtattcgccctccgagaagagaataaaagtgacatgaacactgtactgaactacatcttctctcacgctcaagtcaccaagaagaatcttctggtcacaatgcttattgtgagtaccatttttcagaacttgtaaagaccgtcaatgatatgcaaaaagtatttttttccttttgatggctatggccagagaaaaaaaactactgccttttataattatgggatgaatggggcttgagctgtggattaacagtttctcacgtctacctttgtccttggtctgaaggaacctgctttagtgagaaaatgactcttctggccattatgcatatactcattcacaggaacttatacctcctaactctgtttagaaatgcctcgtgcttcaccattcctgtggtcatcatgacagcagctttaaaatttcatcttatttagccaatatattctaattttaactcttgttccatagatacaagcaatggctctcatgtcaaacttgaaaaaaaataaatagaaatccagcactccccctctctgaccagagaaatttaaatgtattctgcatcttcattggtccctttttatttacattgaaaatctaagctcggattattgtattggtagtaaatgtatgatttttttccctataacttagtaaaataagaattagtaggaagtaggaatagggagtgagcctggtaagtttgatgagagctaatgtgcattcagccagtgggtggaatttttgtgggctgaaggatttttaaagatgacttgcaagtccttcactcctagctcattctggttgagttagttgtaggaattagtacagtaggactactcctagagtccctcaccccatggtcctgagcatttgccttgctgctgcatgcctgtctttttggggactgtagtgccttttcactcctagagttttctttttgtctctttgtggaattgggattcttggtaagttaattacatcattttttcatggaggaaaaaaacatacatcttcatgctattttttatttcttcagaatgaagggaaactatctaccatacacctctgattaacaagagtgccactcattcagttatatgcctagctggttaactctaaagcgtatcacattttttagaatagccactttaaaaaatatgtaattatagggagagttcattgcctttgctaccctagaatagctagatggtagggaaacgagaaagatgcagttgagagggaaaaatatatatgttagtacaatgtaatacttcaacttcccccaagtgacaggtttcagctaagaaatgatacaatctatggcagcttgctaattttttttgtcagtcaaaagaaggaagaaagactatttagatgttttttttaatttaatgaaaggattgttaaatctcatttggataaagccaagactttctgtcagaaaagggtaatgatgaggagggtaggagaatctgtcagtttggacctagaatggggtggaatttgcctttataggaagctaattatggtgagtttttctttttattgtgattacgtttttaagaacttaacagttttctgcactaaaaatagaccaaagcctagaatccttggagcagcggaagagtaatgattgtccaagactgtcgctgggtttcttaaattctaatttgtaagatataggggctcagctcgctccttttgcggagtgattgtaagtaacgcttgccttaagaatctcattattggaacacggagccatatttcctctgagaattctggagtagctttgagccagggctgttcatttctcaagtaatcacgctggtgtgatggagagagaaaatggcagctgttcggagctcaggccttcaattttcttcagagtccagtcactcaagtgtgtaattacgcggggggtgctgcagaggcgttgggccctgtcagagaactggtttgaggctttgctttctgcttttgccagtcaggacaggcagaagccaatgggactctgactttccacgctgttctttttttctcccaccttgtcatcctgattacttcttacctgcatggatagtacccagactttctttccaacaggctgagctctttagggaaaagagctgtttcagagtttgagtttgggtgaataggatggaggaggaggaggacaagggggatgggaagaggaggaggaggaggaggaggataaggacggttgaacatgtgaaccaggaagccagatttgtccctttctttattttggtgtcattacatttttctttaaaaaaaaaacaaaaacaaaatgagacccagtaaacataagaggatctctaagctttcatgtcattaatttcttttcaaatatcagttgttttcatttcatcttagagatttggaaatcaagaagttaatgatatgatcaagctcagggccagctagcagtgacttatggaacatgggtaaaagctcaagacggtgctcttttctgatctgatgttactgaatgccagacatgtcttcctcttttcctctttgacaacgcttagctgctcccccttccttcttcctctccctcctcctctcccacatctgcattaatggtagtagctggtaagagccattttggttgtttggattattctttcctcggatcttagtatcttttacagatgtcacctgcacatggtagcactttgactcccccagcttgtgttctctgctggttcccctttctttgcatatcttggcttcctgattgatggttatgtgcccagtattccattctctgctttctagaagtaggaatgttgatagtatgctttgctgagctagatgatgatttctggggcttttgaacctacagggagggaggtatcaagaaactcaggcttccgtgagtcaatgtcatgggatatgcgttgctctagtaaagaggtaccttcatcctctccaggtgttagcataacctgcccagtggtaacttgcctcatggactctcaagcagatttctggtaatctttcactctgtctggaaagcaaagtatcaggtaaaaggctaaagtcctatcaggtttcctccatttaaagggacattgtaacacaatttaacacaaagtctggaagaccaatagtacatttattttttgaaagctcttcttatttcttaaatttaactttataggaaaaagcttagaactcagaacattgtttatgtttgcttagagatatttaaggaactctttaatctttagccagattaagctaattggtacaaatacaaagtatcaacatcttcatagctgtctagatggcaatgtacatatcttctagccaccttgatggtaagtagtcttcccctcactacttgtaacttatttttgatacggtccacatgaacatgctataaaccatgcttctgtatgagtaatgccatgcctatgaacccctgatttggtttagatggggagaatttatgatgctgatcagcacctttccttcctccacttaacctgactgcaaataattttgtccaatatgtaaataaagaagaaaagtctttctcagtgattccacattcactgaataagggtgatattaacaattgttaaacttaccctatgacattttttgggatatcaaaaagtgcagatatgactagaagaagctaccagttcattgctgatcctgggtttagtgcctacccggctaaataatagttaatgtcttgagggcattacacataaggtcacattcttttcgttttgaattgccttctaagatcaagttggactatgttggtttcttctgtcagtcaactgtgtaactttggctatgctttttttttttttttttaaattaaagatgtggtctcactgtgttgcctgggctgctgtcaaacttctgtgctcaaacggtctcggcctcccatcttggcctcccaaaatgctgggactacaggcatgagccactgtgcccagccttggctatgggtttaacgttttatcatgtttgttgtatttctgcaaattcgaactatttcctatagttagctaccatctaggtcaaaagtaaaagcaagaaataactgttttgtaccagtatggctgaataataattttcacttcgttttatgactctggacagttggaacagacctttggttggtggattgggatgccagatttttgcaagtgacctgtaatcccaaaatcagcaggttggctctttaaacaaacctttttatgttgactaaacacatctgctgacctagacaccatctaaaggtatccttacaaaatgttcaccaggattagatggtgatgtttgtttgtccagttgcccaaaagaagcctgtctctaggacagagggtaataaacttcctgttggatgttagttggcatcttaagatgggtggttctgaaaaaccctgatgttttcttgcagaacctgaatgctgtgtctaggtcagggacaagacagggttgaggaagttattctatacataattttctgttgccaatttttttctaagtattaatgatgacagtggagaaaatatttgaatggaaaacttccaagtcagaatagactaacgaaaatagtggttaattcatactgtttgataattacttcacatttatttatttatttatctatttatttatttatttatttattttttgagatggagtttcgctcttattgcccaggctggagtgcaatggcgcgatcttggctcaccacaacctctgcctcctgggttcaagcgattctcctgcctcagcctcctgagtagctgggataacaggcatgcaccactgcacccagttaattttgtatttttagtagagacggggtttctccatgttggtcaggctggtctcgaacgcctgacctcaggtgatccacctaccttggcctcccaaaatgctgggattacaggtgtgagccaccgcacccggccttatttatttattttaattttattttattttattttattttgagacggaatttcactcttgttgcccaggctgtagtgcaatgacgcaatctcagctcactgcaacctccacctcctgggcaattctctggcctcagcctcccaagtagctgggattacaggcatgcgccaccacgcccagctaatttttttgtatttagtagagatggggtttcatcatgttggtcaggctggtctcgaactgacctcaggtaatccgcccacctcggcctcccaaagtgctgggattacaggcgtgagccaccacgcctggcccacatttattttttctaatctccatagttcgcttttcttacacatactgttgttttctcctgaagcccttttttactgcctttctctcatagtggaaagataaaataaaaaagtggtttttaaaaaaaagtgcttttacgtgttttgctttgttttgtcttttaagttagagcatgatctgtaactgccaggcgcagtggctcacacctgtaatcccagcactttgggaggccgaggcgggtggatcacaaggtcaggagatcgataccatcctggttaacacggtgaaaccccatctctactaaaaatacaaaaaattagccgggcatggtggcgggcgcctgtagtcccaggtactcgggaggctgaggcaggagaatggcgtgaaccccggaggcggagcttgcagtgagccaagattgcgccactgcactccagcctgcggaacagagagagactccgtcttaaaaacaaaacaaaacagaacaaaacatgatctgtaactatgcaagaggataactccatttttaaaaattttagtttcatctgtaaaggtaaacctatatttcttttaaagggaatgcattctatatcaaatctgatacaggttgcggaggtgattagtgtgcttttttttttttttgagacggagtctcgctctgttgcccaggctggagtgcagtggccggatctcggctcactgcaagctctgcctcccgggttcacaccattctcctgcctcagcctcccgagtagttgggactacaggcacccgccaccacgcccggctaatttttttgtatttttagtagagacgggtttcaaccgtgttctccaggatggtctcgatctcctgacctcgtgatccgccctcctcggcctcccaaagtgctgggattacaggcgtgagccaccgcgcctggccctagtgctcttattttgtcatgttggcttttgtttttaatgttgagactttagtctggctttgtacagaggagtcgagttgtggcattacccagtagacttcttatgtttttaggcattttggtgggtcattccaatgcttttagtaagtacttcggaaaggagtatgtttgctctattaagaacattaggaaagggacttaggtaggaaaaaattatgttggtttccctacctactgttatctgtcaattctttccttctgtctttctatggtcctgtttctggtagttttacatattcctttgaaattctgttttgctcattagttctcagcaaaaggtgagacttacttgcatttcctttctcctgtttgcttttatgcctaggataggtagaacagattctctaatctgtgctacctgttcaatagaacctctgggtttatcttcactttaatagcagcttttatttttctcactcagatgagtgaattatctgggtgaaatgggtgaaaacagtacttgcacttccttaattataactcccatcatatgttttatgactctggacagtcagagcagacctctgattggtggattagggaaccagaatctcattatatcattttctcaaaaaaaaaaaaaaaaaaaaaagggtttgagaaaccttcccagcataatggcattgagtatttcaaaagtatttaccttgtgatgtggaaggtaggggttttggaaaaagcatgtcttttatttatactgcatttatttatacttctgtgataaaggtctataaagagtatccctgagatggggaaggttaagtatgaaatagaaattcttcaagaaaagggctgataatcaaagtggggagattaacatgcagcaacaagcaggccctttgggtcttctttcatgtcccattggtagtagggggagaataaatatttattaaaatacaaaggcaattctttaaaaaaaattttttttttttttttttttgagacagagtctcgctctgttgcccaggctggagtgcagtggcacgatctcggctcactgcaaggtccacctcccgggttcacgccattctcctgcctcagcctcctgagtagctgggactacaggcgcccgccaccacgcccggctaattttttgtatttttagtagagacggggtttcaccgtgttagccaggatggtctcgacctcgtgatccgcacgcctcggcctcccaaagtgctgagattacaggcgtgagccacagcgcccggcctaaaaattttttgttttatttatttttattttttatttttagagatggggtctcaccatgttgcctaggctggtcttgaactcctgggctcaagcagtcctcctgtcttgacctcccaaaatgctggggttacaggtgtgagccaccctgcccagccaaggcaattatttaaaactccaagtagaggtagtgatatctaaatggatatattttatatggtgtggtgttaataattactactaccagtagctctgtaaagttcaaaaaggacagacatttataaaaactgcatttacatttttttcagcttagatggaaattgcatggataatggatgaatttagggaataaactgatattccactggactccagtaaggatatttctctcagaatatgattgagattattttcttaacattttttacttcttagaagaggaaggacccaatactgaataaaccatggattctatagtaggagcctgtttttttcctctaattcagctaaggattcacatgtttaagtatcatggaatgattcttggtacaggaagaagagaaatgatttgggatgcagaattgccagcatatgagatggtgttttagttagtgtgtgtttataaataaataatttattcttgtgtttctgttttgcatcctcctgggttgctgaaaatttggtttatgagatgaaaaccactggggtggttctttttgccttatatctaccttctttccaaaagtgggaggggaaacaggaaggcctttagtccctgttgtttaaaactttctcttaaaactttgagacatatctattatttcttactcagaatccccttggccccttttagtggtctctaatgattccttctgcgtgttaaaagtatagtgttgatttataaggaaatacattaggaattttgaatgagggatttgggctgcctctccttagccaaacttcctctgggatcttctttaccacattgtttagggtaaaaataataggaagtttgcattttcttattaatccagctgggtttactttgttttcattccttttctctattttaaaatcctatccacctgttctttttaatatgactatctatgttcttttttacattaacaattaggatcagttgtgtggccgggaccctactctcactgatgagctgctgaatattctcacagagctaactcaactcagtaagaccaccaatgccaaagtagcacttcgagcacgccaggtaaggacatttgttggttttcttaaaggagggatggctttcatagatcaggcagtcctagacacaatgaacttttgcttaatcactttacaaagaacatgttattttctatatatgtgtcacgttttcctcagaacaaatgttttcatgtggtatgtttttttaaagagaaaggaaaagattagtgctgcgtctctttaaaatagaagccctttccccattaaaaaatcctggtatcattcccttccctccctagtagccctgtgatagtaaaccagggtcaggtggaggaaaggacactcagggaagaaaatagactcagtatttcttacttcccaaagggagcttagaagcagatgaaaacttccaagtgtacaggaaataatcaagtgtggaaagcagaaagataatgaaatgaatcttaggcggcagcaatcagaacaaccccagagaagtccagttagtttcaccctgcagtcttcatttccattccaaaaggtttcagcagggaagccaagagttggcactccctttgtgtttcagtgcatgggcattgacaaggaagcagcatttgaagctgttcagtgaccttctgctttctctacaattgtatccatgtcactgaactactcaaagctattgaacctctcagtgacctgctgagggtattcagatcctaccgtgtcactgtttgtttgtttgtgacactgctttcactctctctgcccctcacacactctggtgttacttcctgacgcgttctccttggtgccgagtacctggggctgtcaaagcagctttccctagtctttctttctacttcagagttgtaaaaggctagctctgctgcatctacctttcccacagctgctccctgccagacctgattcccaattaacagctagtcatgcagtccctaggaccagcagctttgcaatggtaaatcacatacactgatggaacttgatcgaagctgttttctctcccttccccctacccaccatgggaaattggccacaatgcaaatcatggtgagagtcaactgagattcagtatttggtggcactggctttatgttacaggacctagaagttgttttacttggtctctgttttatctgtgatgcctgcacttacagatttatatttattgcttttgtatcagagctgcctaataggagtctagaataatcactccgaggaatgtgtgcctcctattttgttctcactctaggttcttattgcctcccatttgccatcatatgagcttcgccataaccaagtagagtctatcttcctatcagctattgacatgtatggacatcaattttgcattgagaacctgcaggtatatatatatatatatatatataaccctttcctgcctatctggactcttacctcctttattctcaagcatagtttaagtaattagtcacttaattaattaattttgattttccatataatggagtttcatatcttgactttctaaaatgatttatacttatgaatatttttttcatacaaatgctgttagaattgtggtttagcttaaaaatcaaataggcctgccttgatagaagtgtcctattgaagtctttatctttgtactttacctagaaagtattctaggccagaattaaatgacaaggctggttgatttctgatatatatatatatatacacacacacatttctctgatgatttatgatatttgaatcagatgtatacataggtagttgttactcttctggagacaaagctatttaagtatcatttaattttaattttatgttaatgcttattattaagctttataagaagcccgtttttaagagattattgtctaattttactactaatcagaaggaccaccgcaattattttttaaatgttatcttctcaggaatgactttatatttttctacctggaaacaaggataccattgttatatctggcccaggggaatctttagactttctgtaacatttcttcctggggaatctagaggggaaaaaaggatgttttttcttatttggttaatagctgaaatctagggtttcaactggagttcaaatctagggtttaccatagtggagtattgagacaatatttattttatttaatttttctgagacagagtctcactctgttgcccaggctggagtgcagtggcataatctcggctcactgcagcctccacctcctgagttcaagcgattcttgtgccttggcctccagagtagctgggattacaggcactcactaccacgcctggctaatttttgtatttttaacagagacagggtttcgccatgttggccaggctggtctcgaactcctgacctcaagtgatctgcccgccttggcctcctaaagtgctgggattataggcgtgagccaccatgcctggtgaagacaatatttagagagttcagataaatgtcagaaaagaataacagtcataaacacttatattagcatacaaataatgcattgttaattcagtattccaagaattttacatgtatttactcatataatacaacagccctatgaggataggtattttattttctccattttgtagctcaggaagctgaggcacagagagattatggcattcagagacaaaattcttaggtttcactaaatgcttcaaatgccaaatagtgtccattgaaattgttctccttttgatgtaaggcttaagcctgtctttgtatcttctagaaactcatcctatcagaaacatctatttttgatgtcctaccaaacttcttctatcacagcaaccaagtagtgaggatggcagctctggaggtaagtatttatggtaatgggacatgaccttttcctttgtttctagctggtttcttctgtctatttggctgccatgtcagttctagttctctggccttaaggttggttcttaagggtagttagtctcttttcctctgaaacagtatgtgcttactcagatactttactcaagtgtttcatctgaactcatcaccagcttctaggttccaatcacaggaaaatagctgccagcatttttcagtagtttctattttccaggtatttgaattctcccatttcataatgaattaggattccttgtaacacaaaaagcgaaaatatatggctgatcagagcatgtgtcatcttaccattgtgtgatttgggccaaattaaaattgattttagttatgtttggattgtcaagcagctcttatgaaatacttcctcaaaggaaagaaagtaatagcatttaatgaactgtgttttaggtattttatctttctcatttaatcctacagttactttaggaagtaagaagaaagtgagactctgagaggttaagtgatttgtccaaaatcacatagataataagtggaagagtttgcatttgaactcaggctaatctgactccaaagacttctgtttccgctacagcacactacctcattaagcacaaaaattgcaggccctgaataccactgtaaagttgccaaatagttgttttttgaagatggggaaaaagagtgttttagatgattttatgtaatgtaacatcacggtagtctgttgccagctcttttgtgttactttttatttgtactctgtggtagagtgtaaattatcctactcagtaaatgccaaaagttttaaaacatttaagtgttttgtagtgtttttatgtcatttaatgagaagcttccttatatacttcccgtgccatagaatctcaggtagcattttatgtgcatggcaaatttgctgtgaaatgtgtgaggttggactgacagtttttgcagagatgtagcctattgctgtttctttttttaatttatatttatttttattttatttcattgctgttcctttaactcttgagtcaagttcaagtatttgagatattatatgtcaaattatgtcttactgcttatgccttactgcttttgatcagagtttgctgaaaactgattttgagcgggtggggaagtcggggaggacgcaagacaaagacatgagatagtaaaagagttgaactgtactgtgattgcttgtgtcttctattttcactctgtaagtggctcaaaatcagcacctctcatttttctcactgcttaatcttctgttgaaatgatcatgcttaatagattaatagttgtagttctatatgctgtcttttgctaaagattaaaccttctccagggtttaggttagtgtggaagaaggtttacagtgcacataggtgtccagcagaggcagcctagttttgttttcattagtagtcatggttatagtattaagactccagctttattaattaaagcaatatatgtacgtatacatagggccttgggacttctctccccacagagcaccttctgcctcagatacctcgtttcaagactctttttctgggctattttcttaatttctgtttttgaaatttatttactgagggtttcttttgaaccaggtgtatgttcgaagggcttatattgcctatgaacttaacagcgtacaacaccgccagcttaaggacaacacctgtgtggtggaattccagttcatgctgcccacatctcatccaaacaggtgagtttgaggtggtatgtgcacccgagccagccagaggtataccatgagaatcaaggggagtaatgtgtatgacaattccatgtttttttagttagaaatgtagggcaaaaaatgaacaatatgaaccaaaagagaagagccttttggtgcccacttctttgatctaaagagaaaaattatggtctaagtaagatgaaagtttaggattactccattcattcttgcttgtattatgtcactgaggaaatagtttctttcttttttaaaaaattagaaagaatttactagcattttacttgctagaactttgccagaaaaatcactctttttaacaatttaaatcagcaattagaccaaaaaaatactttgggtggaatgcttttcttttctatatgtttgctatgggttgaggttatatctgagccagtttcattatctccctaaaacagaccacctgaatttagcagttgaaattcaatcagtttttaaaaattacattgcagaaccaaacttcttaatctcaaataaattactgaattaagccatgataattacattatttgtcccttcctgtcttttaaaaaataaaatgtacatatggacgtttttgtttcagaattgcttttgttttaaaatgaaaatactttatcttatagactatcttttaaaaagtattctaaggcaatgaaaatctaggaattccacccacacataggttcatcccctcctgtactttcattctttttagtaataccacaggaaatataaataccacagccaatcttaacctgcccctctccatttcttctttatggcctttggttcttcacttggtattacaaagtactgtgtcttttgggaaccttagttatagacaccagaaatggttttgttctaaattgccacttcacccaaagcaatagaaaccctttctggagacaaagaagtctgtgctgagacttttggccactggatgccactgttgatccagcagaggtcggcagatgagcagaggcatcttcagaaaaagtacctctcttctttgtctcagaatatcctttcacttctctacctcaaaaataccttatggctggcagagaaaagcatatatccttgatttagcaagcatctctcggtacatttttgcctccatggatttcagaatctcattttctagaaacgaatggttgtccttcagtgagcggcgaagtactcatggcacacataggcacagcactcagtcttctttcttttcctgcattccttgaataattgtagagaactacacgctgtacttaatgctctttgtaattctcagggcagttctccttttcttcctgctttttcctgcttccctttgggcagtgatttgtagtcaggctgcagggctgcttctgatttccttccctcctcatcactctccttgtctctcttaattgttctccctgtcctacttttttttatttgaggatatgtccagtttggtgagggaatgttggctgaaaaatgagagaaattcttcttgactgctttgttaagaaatcttattcacctttctatgtcaagagtatgaatcttggttagttcaatgtggttacaaaacttatatgccagtccctcccaacatctggacatgcctgtagataaagatcagacttgaacataacagtaatcctgtaatctccctgaagtctcccttggttgtcagtgtaattctaaacctgctggattattattgttattgtcatcattattattggtataactgtgaaggtgaagataattgcaaaataaaaaggaaaaataaaatcatctttgtgaaaaccagaaaaatgttaaaatttctttaattttttttttgatctaaagttctgtttaggatcaaatgatcaggtttgatcataaaatgatgtattcagtttcagagtatagcttgttcagttattgcagatttactacttgaatttagttttataagattatatacataatatattataatatatgaaaaatgtgttttttatatatataatatatatgaaaaatatgttttttatatatataaaatatatttttcccccaaatgtttttgttaaaatttggatttataaccttattatgacaccagctggtgtactgcaattgaattctgacactagccatctgaagttagatcagatgccacaggctaagggctcagtccaccaccaaattgtccctacttcagatggggccataagtggggtcccctggccacttgcacttctgaccaactggctacaaatttgagggtcccctcaattttctcagtttgataattccctcagaacaactcacagagttcaagcactacagttttattgtcaggatcagccaaaagcacgagacgcttagggtgaagtgtgggatggtctcaaacacagagcttcccagtttgttccctgtggaatcagagtttatcaaccctctcagcacatccatgtgttcaccaaccaagaagctccattgaccttcagtgtccagagtattttaaaatcagggcttcattacgtaggcatgcttgattaaatcatagcctacgtgattaaactcaatctcccctcccagaggtctggctggctgaaagccctcaaccttctaatcacacagttggtctttctagtgaccagctcccctcctgagtcatctcatctcttagcataaactcaggtgtgatccaagggacttaaaataacaatgacactcctattacttgggaaattataaggatttagtctctcttccaggaaccagagacaatggccaaagtctttattatacaataggcctgctcatcttaaacagaaatctaagctcttttagatttagctagttttgagccaagtacttttcttctttttctaactccagtactttttttgtatgttattgttttgatcaagcaggcgaaaagcatattgtttctcattctacagaaagaagttacagagggctaccaatatttgttccactctgtcctgtaaggctcagttatgtccactaacctctagattaatgattctcaaaattatctgaggggtaatttgaaaatacacatattggagtcctgactttcaagacccgattcattttggattagagtccaggtgaccactttgaaaagctcctctgaactctgatgaacagctataattgacagttactacttctaaaccagtactgtcaaatagaaatataatacaagctacatgctatttaaaattttctattggccacatttaaaagtaaaaagaaacagataaaattaattcaaataacatcttatttaacccattatatccaaaataccatttcaatatgtaataacaattgttaatattttttcttttattcatactgtatctttgaaatttagcacgtattctatacttacagcatatctcaatataaactagccgtatttcaagtactaccctagctgcatgtggctaatggctgctatattagacagttcaacttagaccaaaaattaattaggacagtcacactgagccctctttttttttttttttttttgtgttactggtagtgcccgtggagagaggaaaaattattattcttatgttgcttattcttagtagttacaggaattattcacagttgatattatagatgttacactacaatattttatgcatgctttaaaaatcagtgagaataaagaaaaggtatatgaatcatacatattttacttatcaatataaaacagaattttatatttttcccaattgaggttaacaaaccaatttttttttcccctcccatagagatggggtcttgtcatgttcccaggctggtctcaaataattctcctgcttcagcctctcaagtagctgggactacaggcatgtgccaccatacctagtacagaccaaaaattattgggggagaaaacaggtttttttttttgtttgttttttttttttttttttgagatggagtctcactctgtcgcccaggctggagtgcagtggcgcgatctgggctcactgcaagctctgcctcctgggttcaagcgattatcctgcctcagcctcccgagtagctgggactacaggtgcctgccatgatgcccggctaattttttgtatttttaatagagacggggtttcaccgtgttagccaggatggtctcgatctcattaccttgtgatccgtctacctcggcctcccaaagtgctgggattacaggcatgagccacagtattttgtttaaccaattttttgtgttttctttccttgcacttggtcttcacattcctagctaggtgtttttgaagtagacaaaatttgtccagcacatcgttagaagtgtcttagtaagctgtaatatcaaagcaagactgcaatctcattgtgtatggaattccattcctgcagcttttttttttttttttttttttttgagatagagtttgctcttgttgcccaggctggagtgcagtggtgctatcttggctcaacacaacctctgccttccaggttcaagcgattctcctgcctcagcctcccgattagctgggattacaggcgtacaccaccacaccccactaattttgattttttagtaaagacggggtttctccgtgttggtcaggctgtctccaacaccctaactcaggtgatctacctgcctcggcctcccaaagtgctgggattacgagcgtgagccactgcacctgcccttgtttttaactcctcttactataattcccagtcacgcagtttgtttttgactgtgatttagcctccataggttggggtgaaacacggcactctgtctgcaaactggcagcagagttttttttgtttttgtttttgtttttttttttattcaggaaaatcccttagttgctgttgggattgaagacctgtatcttacttattaggacctattttgatttttagagaagtaggcaaaatatattgcaaatgactaggggagcctctgaaaagggagaagacacctgtttttagcacacttgaacagttgctttgtagtaacatatttggtacatttttgtttttcttttaattcatcataggactttgcattgtttgacatgttgcggttactctgttttttggtataattcgactatttttagaaaaaaaaactccaataatttttttaaaaagcagattactaaatagtttattcctaatctgtgtgacttcctatttcatttcttgctaggtgtgcatcagtcgaggtatattatctcctttttgatcttctacccaagacttctaaattttttttctggggactgtagttccaacttatttggcatctgtaggtcttattcagcagaggatccagttattagaacttcactcaggcaagcttctggtctggatttaccctttacttctaaaatttccttcacttgaacagcagctaaagagatttttctgatttaagcatagttagaaacatatatatatatatatatacacacacacacacacacacacacatgtgtgtgtatgtatatgtaacgtgtatggggtgtgtgtgtgtgtgtgtgtgtgtgtgtgtttccttttttaccttcttagcattaaaggctgtgtgattctttttgaggggaggggattttttttttttaatgtgtcattttttaactgacttgtgttcttgaaggagaagtgactatctcaagttgttttcatggtgcaggaatattcagggcaactagtctatactaagggagcattttattattgtgcagacttctagaacctaattctctcattgaagattctgtgagcccagccctttagtgagttttacatgaattaaccctggagttcaaactatatcattgaatattcctttttctccttctttccctagtgagtcttagggtttagagcccaagttttgtatatgtctgtcttttttcctattcagaaacttaagtatcactcactggtgctggtgatgggaaagcttgttacactgaagcatcatcctgaatgtctgtattttgcacaattcattgactcatttgaccttcaggatttcactaagctttgggcatattaagtgcctcaggataatctggaaacaaattcttcagtcaactagtatttgatcttttaaaatatagttatatttatacaaacatatgtaaagtatattatcccataaattgtgcctatacatatgactctgtataatataatatgacagtctgggagtacacaatttaaaactccaaatgatttttataattaatatacgctagtgaacatgagtaatctttttaacctttactctgtgattcaaataagaagcatcacatttgatgcaggagatggaggtgtactttgttgtacgtttctgtacatatataatgggtgaggacctattggtgtttatttccacctatttcatagatggaaatccatgctttagttaagtcggattccactgtaccttctctgctgtttgctacttgtgaatttggccttctgtgttataatgttttaattcaaatacttcccttttctcaagtcttacctccagaagaggtcggctgtgttttcccctgatagcatgtgttttggtcatggctgagtttaggctgcttggcatccatcctcaatgttcagctgtcagtgggcggcctctggactttttattcataaggaaggttagaaatcaggagccttccatgtgactaattggtagccaactgccattctcaagaattctgataatctttaacacccagagattagacctttctttggatagtactgagatactcagaagtcatccaacttgtagcattgtttctgcagtgggagcacttgttgtagttagcaagccagaatgagctataaataaatgaaatcttacagtgcttgcttccttcattcagggtagtctgctgataagatgcaagtatctggcagaagagaagattctcagcaggtttaagtgcttaccaaagtgctttcctgtatccgtggctcagcttctagtctctgctgtgttattttggcactctagacttgtaagattggagagttgagtttaaaactctcaatatatcattagggtagcccaaggtcccttcttgtcaaggaagactagctgagtcctgggggaaggaaaagcagaatccaggacacctgtaaatccccgtagttttgtgctgtgggttcgtagctaattatatagcaggcaacagtaatatgctgtagctctgttgatgtacttgtttcagaaagagcaaaaccttccagcagagcaaagaaggggctttggaggggctgcaaatgaatgaagtaatgatcattttattgtaaactaaagctctgcagtagactcagggcatctgaactgcaaggaggtggtgggggagatgccagtagaaatacgtggttcagatgtgttttacagttcttgatttggattttcctgcagaaatatagtcatgcaaagagaccaccactggtcacagccagtcaaattgctctttctcctatggtactgctgttagtggctgctagtaggttattcagccgacctcttctgattctgctttgctgcctgatttcaaaagagttgccctatactggctttcagtcacagcttgatgtaaccactgcttgtttgcatgcatccccatcattttcatatgggctcttttttttttcttcttcaagttaggaagcaaaagaatcaggagcatttttatatgataaaagatttatataaggccagctagaatcaagccaaatgaaattcagctggaagggatggtaaaaaggctcacagaacttgtggctgccagagaagtcagtgttctttaaattaaagagggttcagctagcaggcggcaactctgactttgcattcatattgaagcaagctctccagccattctgggcaggcagagcaataaaatcagaggtgacttagtgccgggaacctcagaattcacaggatttctcttgtctttctctaaaatctatactgatgtggaatgctaacttggagagcggagataagaaaatgccaagtctagattgtggtttatgacaccatattgaacaatgtcattggaaagcatcctctttggttttttggttatcacatctgtaaaatggagctaatctactagaaagaaagtggttctaatattcatcaaatgttgtaaatgaagattcattataataagtgttttgaatagcccaaacagcagataggaagtgaatttatgtcccatttatgtatttgaaaatatacttgattgccttatcaaagattgagcaattttactttttttttttttttttttttgagacttactttgtcacccaggctggagtacagtggcatgatcttggctcactgcaacctcagcctcctggctcaagcgatccttccacctcaaccttcggagtagctaggattacaggtgtactgtgtgccaccacacctggctaacttttatatttgtgtgcgtgtgtgtgtgtatgtgtgtgtgtgtgtgtgtaaagatggattttggagatgttgcctgggctggtcttaaactcctgggctcaagtgatccacccacctcagtctcccaaagcgctggaattataggcatgagccactgcgcccggcctaatttgactatttttgcgtgatgagtatgcagtggaatgtggcaaattttattttcagctacataaatggaatatttgactcgtatacaatctcttcccttagttgtgtgtgtggcttttttttttttttggtacagagtgttaatctagctttctggtgtatcacagtagtgtgcgatatgccacatttgtcatattcttaaattgaccatatagcccttgtataggatgaaaaatttgtagtggccaggtttgctggctcatgcctataatcctagcactttgggaggctgagataggaggatcacttgagctcaggagttcaagactagcctgggcaacatagtgggaccttgtctctatttcttaaaaaaagaaaaagaaaaaaaaaaagaaaacatgtaaatgatcattatggacatgaccaaatatttatctgttaatagacagtttatccttccttccttccttgcttatctcccttacatccccacagattcttattctacctaagtggataagctggctctaaacctacttacatgattgatttgggaccattcctttaaaaattagagatgttgggagtttttgctttttgacccatactgtgtagatggtgcataattcttataacaaagcagcagggggctctctgtaggagcttgagagttgctgatggagaaagcctggctttttgttgttattggtgttcttttcagttcgggcctttttctactgaaaacatggccgtcatcctgtgaagactcccaaagggattagaatgtagctacagaagcagttagattattttattagattaggaaatttgttaacagttgagagagattatactggtttctaaactctagaaacctggatgaatggaacctgaggtttctttggttgtagagttctctctgaactgagattcatgctaagaaactgtgcaggcggcccctttctttagcatcctttatatcgtaaaaggaaaactattctcattagcatctgcagttagttttctgttcagctgtacctccctctgttctagaacctgtgcctattttttctgtattgttgaggcccaagtgcattataactaaggatctcttgtaaaaataaaacccactctcctgagtgagaggcttaaggaatccaaacagcaaaggttcaggtttctgcactcagaggttgctcttgctgtcttatgaattcactctgtgatacaggtttgatgcaaagagcatttctactcacaaatcacatgaggtatacagtttgtgtgcagtgatatgtcacagctttttatttatatggcctgctcagtctattctgctccttctactgccatggaaagtgcatcgttttcctccctctatcttcctttccacatatcatcagcaccacccactatgttctgcccattaagtcctctgtgtgctagaaaaccccaacagtgattaaatgctgataaaagaatgttagaaggttaagatatcaaccgatcagcccccttacaatgcccctaaattgtaggtggtaagtataactttgcccatttaacattgaaaataaaggtttttatttgtttgattatttttcagttggggaaatcttttaaaaggagttagtggcaaaggccaaagagaatgtgggagatgtgccttgtagtttcctattcttatcgtggtctttctttcatgatttggcacattctttataaggaagttctgtggtagtcaaatttagataaggttttatttatgagaggcctagagtttttaagctaacagcaatttttaaaatcattatgaccctaaactcatttaattacaaagtattaattaattttaacaacttatcatagaatcatttatcattactttcctgcatgattttcagttcttttaagctcctagaatacagtaccttcccccctgctctccttcatgggaggaagagtatggttaaaaagacttagagcaggtagctgggaacccagattcctggatacttttctttggtggagaatttgtaggtctgtcacatatcctggataagcgattaaagtaggaggagctgtggaatcaacttccctggacctccttattacaccttcagtaataggaacaagaaagaagagtctctaagaatcctgtgaagaattatatttcttattgaagcttgagttaatataccatatcatatagcttaaattaattttcatcagcctgtgttttaccactactctaaatttttttttttttttttttttttttggtaatagagctatttttaaaatccatggtaaatacattttgaccctttccatcaacagctggtgtggtgaggtaggttaggagcatgcctctttggaggtatcctgggggttgaagggtaatgagcacttaattatgtctgctgaatgccagagctgccaaactggagctcctcatgactggtctatatctgctctgacaattcttttattatggctttcactaacttatcagtaactaactgtggttgtttaattacagagggaacatccctacgctaaacaggtaccgtatgtttagtttcttttccaattaaaagcacctttatgtaacttagaatagtgaaaccaggaaaaaaaaaaccacaacacttgacaagataatgtgttatctgctagggagtcctgagctcccctttggacatactaaattattctttctgtttggaaaacatggcttcagcttttcttcagctgttcaaaaagcactacttgaaaagcctcagtatggagaagctcccatctagctgtatatgatagggggtttatctgccttatgtccggccttgctagcaacatcttcttttgctaagttctctgtgtagtttggggctttcagaggagaaacccttaaggttactcctatcctggcaaattattcacagtttttacaatttttagtttctctaatttgcttctccttttagaggagtgcagatccagaaatagctgatctcatgttttatcagtttgttagttaattttctaaagtgttaaaatgttatgatagtcagtttttatttcagacctataataagattaacattggaaaagtatatttaagttttgatgtgtttaaccctgtgtggaggtttccaggctaatataacataagtgatattttagtattttgggtttctcctgtctcttgaaccaagcaaggcaacacaatgcaagtttgagaggataacaattctgattggaattgaatccacaaaatgcaaaagcaatagtaagttgatggcaaggtctttgcagataatcagctacacgtggaactatttatagatttacatttattttgtccctctccctttaaaatattaagtaatcaagactaatcatagcttttagatcccaatttggatgtggagaggaaagggaatgcttttaattggtcttgtagtcttcccttggtgagtgggcttggctcattcctgcctgcctttagccaccctggttcacaagcatagcagtgaggggaaactgaatagtcgatatttcccatggggttcagttgagtgaaaaagctacttaaccccatggttgccacaaacatagtttgttaacttcttcagagggagttccctttaaatgtggtctggaacccttttatctttcctgtctaatgccaagcaagtagaaaagatacaatgcctcacaaacttgcttttttagtaaatatatttggtgatcctagaaaagaggaggatgatagcacttctgtggtaatacaactctgaatcccagtttctagtgagcaccatgtgtaagacttgcttgatgtgtgtttcatttgtttgtttcattcattgtatcaatggtttcctctcccactttgccttctactcccaagtactgtcaaaagatgatgtaccttttccatagtcatcactcgccaaaggaataaaaacctggagtgtcagtctctatagtctgtgtgagcagcactcccatcctacaaagaattccattgccttgtaattatgatttgcgatagggtacaatatgtacccagatatcaagtccacgttgtcgtctctcttccccctgcaacaccgcaggtggtgtacttcaaggagatttttggggcagttccccaaattcaagtgccattgccttgccctgaacttgcttcagatcagtatgctggtaacatgtcaggcaagtcctggaggcatcctttagcttggtccttcctaacaggctgtcctgattgagcattcagaaacactttacagtattatttatcagtacatactgttaaggtacatcaagaaatatagagattcattgtttttagattgagcaaatcagttcagttctcttcaggcatctccgtttagcagctgcttgtcatgcttacacatactttgagacccatgctctgcccttttgtatcttgctggaaattattaagggctttcaatggagatttttttgttttggtatagaagtgcttaactatgaaaagaaaaacgtgcaatttggggttgaaaaatagctctctttcaaaaagggagaactgtaaccccaataactatgcctaccaacccattaaaggagaaagtaaattcctcagtaaagttccttttatagactgtgacctgtttctgtaccctaatgttttatataattatttactaaaccattccaggtgacttaattacaattgttgttttacatacatatatatacctatctctttatgtatctgtgaatacttactctattacagttcctagaaaacaaaatgccttaagcattgcatagttacaactcacttggcttgcttacttccttttaaaggagggaatgctttagggagggggaagatgcaggatggtttttaacccctatgtgctattcattcattggacatcttataatgtaattgtgttaaaactgcctggaaattcctaacagttcttagctttttatttgaagaaattttggagtgatgaaaatatagtttatttagggaaattcaaaagaaagggttaacatgaatccagcaaaacaaccttatccatagtgggtaaaaaaaccaaatctgctctgcaacctgaccctacttcagagttttctcctagttccttttccctactgttactttcccagtccttgctcctaccctccttgtctaatgaacgtgattgaattaccatttagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggtaagacattgtggaactatgtctgtacaaggggagccatggacatctgtgttttggggtctcatctttctgcaaaatgaataaaggtctcccgaatagccatgagccagctaaaaagatgtaacccttgctgtatatgccgttggagaggtatatatccttgcatttctacctctcattcagattctacaagcctctacttgtagtatgggcctggtcagaaaaaaagaaacaaacaaaaaccatcttttcctgtggagctaacagaagaagctgtctgctctgtgatgagtgaaatgtcaggagaaattaaacataacactagagtgagccccacaagagacaatacatcttttgattaaatgcattcagcatctatctcttgatgtatactgatgcattaccctagggggaggggtaattacattggtctgtcactactccagttccagacactttctgttactttaagaccgatgatgacagaagtgctcatatcttacatatgaggaaaacaaaacaaacaaaaaagctttagatcattctttctaaaaaagaaaaaatatatatggtttattaaagtttaaacaatccatcctcctaatttctgccacttggtgaaattttgcatgtcacctctagccactggtgattctgttcaattaactattgagcccaggctaagatagattattcttttagactcagctgccaatggcagtgttagtttcatgccacttgagttttcatggtgggtgtttctcttgtattttttaggatctttgatgaagtgatgggctgcttctctgactccccaccccagagtcccacattccctgaggcaggtcacacgtctctttatgatgaggataaggtataatgtcccttttgggagactgctttgttcccctcagacatgggacttctactgtatactatctttctgactttgaactattataggaaagaattcatccttttaccccactttatagtatttaattttgtatgcctcaccaaagtattttctggaaacaagtggaatataaatcctaacttaaaaaaactatattaattttggagtccatagtatagagtgggctcagctatgtccattgcagctgcctctgaatctctgaatgttgttttaaggatttgggctttggttgctggaattcttactcagccatggcttatatttttgcatagtggtgcaatcatagtcctcagagaatggaggactttagattacagaaaaaaagtaggcattttgttgaaaactttgtctttttattaaatcatttctttttatttatcagtaaataaattattctttctctatgatgttattttttcatgatttgatacttccattgtttgataaattgtaaggaaatatattatgtgggaacatgtccagatggcttatatcactcattttccttcacattctgtgaagagatgtggcaaatagtttcacccccattttattggtaaaaaaggtgagacatagtgatcttcagcttcatgccaagtaaagattgggccacctgttactaatgcctctgctgccttatcttttaaaatttatatgctttacctgatttaatctctctgtggctattgggcagtggtttcaatttgctcattcctactgctgggcaaaccaaaatatcctgtggggtgtatctctttttcaggtattctaccaaatattataacttctatctgcatctgtattggccagcctcataatttctttgacttgtgttcttgagttacaggttcccagggatgaaccaattcacattctcaatgtggctatcaagactgactgtgatattgaggatgacaggctggcagctatgttcagagaatttacccagcaaaatgtaagttcttgattgggtggaagctcgtgatgtcccctttctactggctgtgtatcatagctatccttttatcagttgctagtttatggctatgtcttttatcataactctcagaactatggctagttctgcgtttagggataaaatcccaaagtgacttaataatatataatgaatatctttgtgtgtcaacagataatagacctcaaatatttaaaatgtttttaagggaagttatcttcctaaatctctcccagagctccagtcttgaacttcgaatcacctaccaagtattttcctttggtgactttccacatgtctaagcctaaactccccttaggtcccttctgtgtcttcccctcccctcctttgaaactatcagttatacatctatcctcctttcaattttacgtcacttggatatctcctgttgacatcaaacgccatcgtctaaatggacattttccatcattttgcttcacctcttctcgtccctctccaatcccctcataaaacaaaacaaaaaacctcacaactcactataccttttactcccaatcattcaaaagtcattgactttttccttgacattccttcattctacccctctacccacaatctgtacatatttatttgtatctggtcagtcaccaaggtctgttagtttttctttgcagtcttttttaccctttctctttttcttctttccagttttaaaattcccactgccatctctaattcaaacccttactatcttatacctgagacactgcagcaggcttacttgtgatctacttatcttccttcactttctccctccaaagagtttccattctgctcatcaccacaaaattaaatgtcccaaatgtgctcttaccatgttattttcccacttaacagtgattctctctgaccttcagaatacctccttaactttagcttcaacatcatcagcctattgagagactaacatgtagcctttgctattttgtgaaaagacctgtgttcattgtctaatgtgcctcatttattatacttctttgacttcctctttcctagaaagttttctttcacctttctttctaaatcttgtttgtcttaagaactgtctcaaatttcatctcttcagtgaggacttctgagtagccctaactaaaatgtatgttcctcctttgaattcctaattggtcagcatacatttattagcaataataatgccttttatttataaaaaaattctacctaaattttttatttgcatcttaccacgattccatggggttagataagtcaggaattgttccagttgtacacatgggcaaaagctggagctcagagaaattaagacccctaggtcaccagctagaagatgatagagcaaatactagaacttaaggatttgatgccaggtatagggggcacagatctaggtactttagtaaataatacattcttagccctgaagatgcttatagtctagttgaggggacaggataggcatgcttaaaacaataatctacagttatatttcattatgatatgtgatagatagcaaagtgtcctcttaaactgcccttgatggcaagacccatgtgttctcttggagtggacagcacttagcccatggacttcttgcagagaaagaactcagtagatgttttcaaaatttaattcagtggtgtagacagttcgtaccattggcattcacatcatgtaatgccaatggtagatatctaggggaaaaaatggtaaatttgtgatgactatgagtcttagtacttattccatgacggtgttgtagcacttaaactaactatgagattgcagtggtcagtatgaggaaaaggtgcttccagagaagtgaaagtaggggatatgcctagggctttttctgtagacagaaatttaccttccttcttgcccttggccagtgaccacataaaattaacctaaagccagtgatcaaggtaatctttgctggaagagtttttttgttttgttttgttttgttttgtttttttgagatggagtttcactcttgttgcccaggctggagtgcaatggtgcgatctcagctcacagcaacccccgcctcctgggttcaagtgattctcctgcctcagactcctgagtagctgggattacagacatgcgccaccacacccggctaatttttgtattttagtagagatggggtttctgcatgttggtcaggctggtcttaaactcccaacctcaggtgatctgcctgcctcggcctcccaaagtgctgggattacaagcgtgagccactgcgcccggcctggaagagtcttaatattatatgtggctgctgctgctgctgcttcatgaaataatctgtgaaagtttcttcctaggttttgaggcactaattgcccatgtttgagtatttttccataatttgaccacaacttgacacttcttgttgccctcaaatctaagtgtcatacttatcaacgcatgttgatctacaaagacattttcagccaggcgcagtggctcacgcctgtaatcccaacactttgggaggccaaggcgggcagatcacaaggtcaggagttcaagaccagcctggccaatatggtgaaaccccgtctctactgaaaatacaaaaattagccaggtgtggtggcgggcgcctgtagcgccagctactcgggtggctaaggcaagagaatcgcttgaacctgggggcggaggttgctgtgagccgagattgcaccactgcactccagcctggcgacagaacaagactccatctcaattaaaaaaaaaaaaaaaagcattttcttcatattcgctacatatgtttgtaacattaatgagaaataagaaattacccttttccttgactaggtgtggaaactaaggcacagagaaatccaatatctttgcctaaggctatttagaaaggtaagggtagactgtgctgacactctaagcatagagaagctatttactgcatcaggtactgtgcttatccagggacatttggcattttcatctccttgttaaaatatatgtgtatatatatatatatatatatgaaagaaaaggaaagaaaagcaatttaagaaaaaaacaaaagataaagtggcaactagttttgtttttcacttcatgatcatgctcctagcagtttagaaaaagtttttttttttaaggcacacattaaactatcaaataggttgatccaaattgtccaaataatcttctagtcccagcatgtctttttttctctcatagaaattaggatcatatatttgtaaatgacttgtggaggagattgaagcagtcagtgtaaatggagtttctccaggtgctgatgcctaatcgctgggtaatagctgtggacttgctgtgagacctgcattattacaatgtaatcagaatcctgttgctctgctgttattgtcagccacttgtggaattttaaaagcaataacaattttgattttaaatcatggcattattaaagttattttcttcccttgccagaacatagctactgatgcttgtctttgaaggacttgactgtagtggaatctttgttgatgtcagaagaagtatttctgttcctggccacactgagaaacccctcctttccttcgacacatttttttcatattgttgtgtcaatacttggttatttacagcaaggtgtgtgatggcagtacaaataattttttaatgcagttaaaccaaaatttatttatatttggcctgataatttattattttattatttgcttatagaaaattaatttttccagttatcttttgtttatgctgttaataaaattaattttattactcagcaatgccatcgcagaattgaagaaattggaagaaataacccaagaatgtgcttccttataaggggaagacaatttaaattttaaaaaatatataatatcatgaatgttaagaactggcctataaacatatctcttggttggagttatagcaagaaatgtggtcaaactaaagtctggatgtaggctgtgaaagtccacattacttttctatttgtactattcatatgttttctcaggtcattcaactggtggggttgcttttctgcttgctgttataatccttctttgttggggacctctaaacacatgtcttttacttaattcattaatttgtttctttgtccctgccttttgaagcaagtgaacagtatagggaagaggaaggctttaggtccagatgcccaagactcgtataagtggctgtcttgaaactactggtgtctgttgacttctttttttttttttgagacagtctcattctgtcacccaggctggagtacagtgatgcaatctcggcaacctctgcctccttggttcaaacgattttcatgcctcattctctcaagtagctgggattacaggaatgtgccaccacacttggctcatttttttctatttttagtagagacagggttttgccatgttggccaggctggtctcaaactcccggcctcaagtgatctgcccatcttggccccacaaagtgttgggattacaggcgtgagccaccactcccagccttctgttgacttctaatatactagtcgcctatgcctagtggagatatgaatagttcctaaatttaaaggcctattaaatattgcttttaacaattttaaaagagagagtttttaaaaaatgccttcatgtaaggtaaggggggactgttgtatcaaaactgaaaggttacaatttgttagactgaattctagggatgctgtatctgatggtaggtaacatctacaatctaaacagtttaggacctgtgttttatgttttatggaaagtccttcttttctctctacctaatttcatttagcatctttatcaatattaatgtttacatttgaatacatgcccaacagtatgatttctataagcagaaattgtgtcatggcctacctttatgtaaatcagttctgaggtaatttagttgacttcatatcaccctttctcctccacaaagttctctttcagttttgtccaaatcaatataaaatttatttcgtaagacttagtcctaggagccagattgaaatttgttcacttgcaagtttgaaggtactaagctaagataaggatatccaaaaaggatgtttaactccaccaaagccttacaagggccgaatgggataaaatttagaatgaatggaaatctcatctatcttctgttttacatgtttttgctcctagaaagctaccctggttgaccatgggatccggcgccttactttcctggttgcacaaaaggtactgacatgtgaattgtacctctttaatatttcttatgctgctgctacaacttaataaaaatgggattgtaatcttatgcttactaataggatttatgcagagaaataaccacttttctgtaagtttcatttttaaaaaacattagtttaactcatcatcttttactcaatttctttttgattttgttactaattgccaacttctgctgtctttccttcctttctctcttttatttgaaaggatttcagaaagcaggtcaactatgaggtggatcggagatttcatgtaagtaaaatgaacaataatgaaagattacttactgttttatttgtctgccactgattatttaaccagaatatatgttagaagggctggactgatatttgatccttcttcttttagaaattattataataaatattcagttctctgtaatcccagcactttgggaggctgagtcaggaaaattgcttgagcccacaagtttgagatgagcctgggcaacataatgagacccagtcctctattaattaaaaaaaaattttttttaattcttatatcaagtgttccagctaaaggttttcttctttttttttttttaaccctataatgaattctcaatatatctctgagaaatagttaagaatgaacataagcatttatccagataaataaggtagaaacaagctaactagtaatttcttctgtgcttatagtgaatcaataatcaaggacagccagttgcattttgtggtcttggattctttattgagaagtctcaattctaaagaacaatgatttattatttaaaatgccttgatagagccaagttgctattttttgtcttatgttaatcgtaggaacaggaaataagtaaaaattaaacactctgttgcttattctcccatttaactgaattaactgttaatatttatgagattaaaatttttattgaaaagagaattaagttaatagcctggcatccaaactatggtatacccgtatgatcatacccagtacagtgacaacagtaaggccagaaatccagtttggaatcaatatgttgttttcaaaatgactgattataatcaaaatatttcataaaaattgattctaatgtagctaactaagattctagaggatgttaagaagtcttttttttcttttctttcttttttttttttttgagagagtgtcttgcttagtcgcccaggctggagtgcagtggcgcaatctcagctcactgcaacctccgcctcctgggttgcagcaattctcctgcctcagcctcccaagtagctgggattgcaggcatgtgccaccacacccagctgatttttgtatttttagtagagacaggggttcaccatgttagccaggctggtctcgaactcctgacctcaggtgatctgcccgcctcagcctcccaaagtgctgagattacaggcatgagccactgtgcccagcctgtttggtttggttttagcaattaagataatttggttgttaagccttgcttgtttgcaacaatgaagatggcacttgagattctggaaaggactttctaaactcaaggacctatgtgtgattgcttttattacctttttgtttattaggttttcaagacttgacattttgttttccttcatacagttcaccttgttggtctagtctatagagaaacaagagagctaagattttctgaaatgctttaggaaatgttgtggactgcatgactcccctgtgttattgatgtcaggaaatcaagcagagtgtagatatatgtcaatcaataactttagataggaaacggagtcagtggagaagtatgaggagcttaaaaagaaccctagggctttaggaagaaaaatcaggagcttagagaataaaattgatactttgggatagaatatgaaagcccatggataaacactgtggctggtagatgctgatcagaactaaggtagacatgccagagccaggccctggattttagaagagtattgtgctaggttcttaaatgttactgtgctttttatcaccgactttagaataacagcatattctagggaataacactaaatttgtaaaattgttttcctttttgctaatggattagatggaatcttcacatctatagcacactaactggtttctataataaatacactgatcaactaaaactgttcactaaaatttttagcaaaccaaagtgattagttctcactgacattttctcatatatgtaacacataaaaaaaccctttcttatctctgaatctatagtgtatagttataaatatgccctagtattaagagtatacttaacagctttaaaacatttttttctctctgctgtcctgatatttctggatctaggtttaatagggacatgtataggcaaaatcggctagaaaatgaggccagcagggggtcttccgtgacaatcattgtctgattcctatatatagtggcatcaagtgggaaatcacttaaattatcaagtgacttgatttgtcatgagtgtaggaaaagctgctttagagcatagagaacattaaggtttaagtgaggactgcatttgctctgaagaattgaatggcagaggagttggggtgtttttatgttagtccctttaaaaatgataagtgattttgcaaggtgcaagggcaactattaaaccgaactccatccagaatctattatacaatccaggatctacactagccaggaagcgttggcagaaactgtacaaatctgggggtcactgtcgtggtgctgctgtgagttcttttgctgatggtagcttgacattcatgaaggatgcttatttagcctctgtcatgtcatctgattgtgcttgccccatagttagtgtactgtgaaaaagaggaagctttctgggagtgtcagagatgaatcccttgatctctctggcttcttgataatccactgtgatgtatgcagcctcccctgtccaatgctgtggaatccctatattattgaatggaagagagaatttgcacttgagggagcaaggagaggaggaagtttaccaagtttgattcaagcacattggttagtggaataaagcaagctgtgctgttatatagttgttggtctttcaaattgcctcagaaccagaataagacaaatgagggccagagtagaggttgctagagagctgtgtatattgttaggtactgatttggatgacagtgattgctataagcatttacaatacttcgtagtttagccacagttgtcccagatagctgcccacagctttaaaacatttttagggtgtctgttgccaccctagtccgttgacactgcatggagattatttctgtgacagcagtcttcaccagtgttaaggaggctgggagttgactctgtttccataaccatctaattaaatcaagtgcccataatggaatttgaataactgcctaactttgatatttaaacagaaactttgaggaaaaacaagtctctttttgtaaatatattctacttgttaagaaaaaataaagtagatcatgatgttcatctgaaaataaaaaataaaagaaaaaaatggacaagatgttaaaaaaaagaaaaaagatcaaagtcttgaatggaaaagaggcttcttgaatttctgcagctatctaaactgcaactccacagttttctgttagttaaaacttattgactcactctgtcttagtttcactcacattttaggtctggaattccaaaatatttagcagaaagtgctgtctaattgggatataatattatgcttttttttttttaagctttccatatttttttcagcaaagtttggctaaggacatcggaatacaaattttcaggacttcttcttatcccccattaagtcctaaaaccatgataagattctaaatcaaacagttttacatctgttaataaaatgttaccttttgttcttgtaaaatttcatgagatttaaaaaaaagatctacatatctcccgagagagagttgttgttttatgactattgtgtgattcccactttaaaatgaaatgttttggattatttggaccttgaaggaagagctcactatatgagcagttatcataattagtagttctttttttctttttttttttaagatagttctgtttggtagtggaccaactattagttttcagaagggttggtttggatttttgttttaattacagtctatataattagttctcagcatgttgaggtaaaagagaattgtaccagcaagctcccaatttcttcatctcattaggtttttaacacgattattagtatcataatcagctatgatgttttttgttgcaggttttcacattctctgatttgcggggtgtcttgattggctaatttgggcaaattattttgattgtcttgatgatggttggctgattagaacacagcaagggcataatttcttcctgtgaaacgttgcattcttttgttttttggtaccagaatactaagagggtttttctttgtgtacattcaattatgatattcgcccatgacactagtagaatacttggaaagcaaatacattgatgatggaataagcatgaatgctttcagtggaaaaactggcagtatgaggatgagataggataaaagaatttactaaaactgtaggatcagacttttagatttcttcttttctgtgttttctgtgattctgtggtttttgagtgccaaaagagattactttttgtaagagtcttcagacttccatgtcactgaagaattgcttagtagttccacttttccattgcacagaggttcttgccatctcttgttctgaatgtttaatacttaaattgaggattttaccggggagttacaaatttactcagaagtttaaaaaaaaaaagttgtttatatgatctcatgacaacttttcttagctaaccttaatgaaagtggtttttctaattggtagtcattgcccacctctgccaagaattagtcagtttcttcattatttgtattaaaggcatttccattcaaactgctttatatgcctttcagttactacaaattttcttaattggtttagtggaaaagaaagcattttttattactgttttgtttttgaaaggaaatggttttgatcctataaatgtacataattaaataaatggcatcctaaacaaacattttaattaattagctaataatagttaaggcggaatagaaaagtgtgtgcgtaaaatatcatattatcactttccttgacttttctttcagagagttccatggaaagattttgtcattcttccttttttgacatttgttactttttaggtaatgctctgaaagctgtacctcactagaataaaaccaaaactaggttatataaaaccatgagcatgatatttatcgacacctcagctgaatgcatcttacttaaccttgaagtcagtcctatgtgcttcactctcataacgggtgggggcggtgtcagagaattatttagaacaaaacttgaggagaagttcagtcctgtgtaaaatccactttaaaaaggcttttaaaaaaggatttccctgaggttggtaaatgagctcctaggaaccttttaaatgcagtcttacagttaaaataccaaggaaaagataaaaagatttattaactgtgcaagctttagttaaggtgagagtgaggtgtaacacttatggaacgtattcaagaaattttcaggaaattcaagaaccacaggtttacagcatgagttttgctttgtttgctttctgctttttaaatttaaagtcttaatttctgtgtttttgtctcatcaaagagaaatcctctaaatgaggaatttagattataataaaaagagaaaggtaatactctgcccttgagagatcagagggcatgggctctggcactagagagacccaagtttatcttccagctctgtgattctgagcatatacttgagccaaggcttctgcaagatgagggtcacaatatctacccctagaggttgttgagagcatcagataggacaacacatgagagtacctgccaccagaagattttcagtccatgtttccttcacatttcctaaagctcattgaggatgtgtaggcagctagtcccggtctctctgccttgtactgataagtgtttgattatattgcactcataatgaagaagatgcctaatgaaacctcctatagaggcaaatagtaatgatttgattccagcactgccagtagagcttcccatccgagaaacaggggtatttggcattggtaagttaaatttcagaaactaatgaactctgctaattgaattcatctttgttaattaataaggttctagtaaattgggtttttttttgtataatgccctacaaaaaagcaggaagacctaatgattacaagttcactagttctaaccttattctttcctatacatatagtggtagtgaccaaggtagaatcttatatttttcttcatcttcaaatgttatcatttaaacccttgacattattgacttgagaataaatgtgaaaatcatggactgagcactctatactgtctgagtagtttatattttaagagtttcttaaagagtaacttgggaaatcagtccattaactactattgcagtgactgtggcacaagggtatattggttttatttgctgggttgtgccaagagcaatacctagcaaaaaaatttttttcacttgggagatttaaaaaattcatacattttttttcccctgggagagggtagatactaaaattaggtttataatgtggtgattctcaaatttggaaatggggtcaaagtgatggttatgcggaggatcattcatatatatttcctggactaagcttaggtaagaagcatgtttttctagaaaactggcttctaaatgcttaactgtttctatactgtttgttctcaaagagccatgtctatgaactactgacacatttttcccccttctttaatacagagagaattccctaaattttttacattccgagcaagggataaggtaaggattgatttctttcctatttaaaaaaaaaaattactttttcttaaaagcccaagagcggcttatctttgccatacgttcttcttgccattcttttttctcttattgaacttgtgcttcctgttgccttacgtgtgtcttagaactaaagccgattcctttctgaaagggtttggtttgggaaacaaccaaatgtattgagctactcaacgaaggtgatacctttccaaatcatccttgtcctgtagaatgatcctaatgatgtgatattaaaggaccattcttgttatctacaaatagttcactgatactcaactctactttatgtgaatttgtttttcaattttaaaatacaaaacttcagaccatgttgctttcttcctgttaccggcttatatatttgactctctctctccattcactcaattgacatgtattccagaaaaatactttagtttcactgaaacatacagtacatatacagtaaatacagtaaagttatatactaatacaacttttaaaaaacatatataagtaattatatatctatggatatagtgttccaaagccaaatatctctttaattaaaaaattgtatgatgtttctttgttgagtatttattatgtcctttgtacttatcataagtgagaaaatttttagattagttgggtaagctcaaaacattggcatgtgaagtagatattaatgtgaagcagcctgtaattaatataaaaatgaattatataaagacattaaatgttgtaggagttctaaggaaattgaggattttttgtttgtttttcatgtatatcatcaccacttgtaaaatcataaatgatgaaagtttaggaatatcatcctataaagtacctatataataggtactttagtgcctaatcttatgtaagctgtagcattagccttgaatgtagctcatttttgttgctcattagcacatcatagcttatgtttctattttcaggcatctcttttacattcacattcatagtataattttgtaactgcctcttgtgaactgttttttctctgattcttgtactcagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggtgggtgctgtactttaatgggatgttatccctgagggaagggacagaataatagatatgattcaaaattaggtattatgcttctgctgagagagaacataaaaaaaagatcaggttttcattttttgaatcaaggttcttgttctatttcaatgtttacaaaagtaaatatttcatataataaaggcttttttttttttacaaagcagaaagtgcatctgaaaaaaaataaaaaatgaaggctctttttccactttaatttgatttttcttggtagcagaagcataataacactcaagaaaagaaaaagcatacaaacagaaaaatcacaggaagaattgggtgatggtagagcataaggagataagttaggaaagaggtgatcccattgtacacctgtctagaagtatgggtagtgtctgtatatagcaaggcacttcctgatgtgttcattattattatatcccatagccgtaccctttcttcagcttttcctttctaaatagctctgtttggcatatgtgaaatatcatcctattgaacttacagctatggggatgcccagtatttctacctcttggaagggaatgatgcactaaaagtaaggaggaagggctgacatggactctttatctggccctttcctgcccctgctccctgtggttactggactgactctagggagaaagataaacaatctcttcaccaagtgccttatgattcatgatatactgctgcttaagtgattataatagccatttctttattgcctcttttaaactacattaatgttgattattttcttcctgtataggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaaggtacatttctccttagcttctctcccagcactagcaagcataagcacagaagttcattcatatttatctcacttggacttggaaacaggtactccttgttcaggctgttgagcccttaatctgtaaagtttatagaatgtttataagattgagtttctgggacagtgtcaaaaatttgatatagccattgaaaaaacagttctcaaaactgaaggttttggtgttagcttgctggtcacttataagcagtacaaaaacgtgaaaacattttcttttgttggtacctattttatatttgccataatagtggtcctgttttgtattattccctactatttctcatctggaattattaattttactgttactaagcattttggctaaattactgcttctgtgcactaaatgttaatcacctggtggccttagtgagataatgcaccttctcaaagtgtctaacctatctctctttagtgtttttccacagggagagaatttggctgataaggaatttctcatgtattatgtatattttcttccctgaggttctattctgaaatgcattctatataatttaaggaagaaaaacaaggtgattttgtacttgaccttttatcccaagtgtaataaagacaggctgctctctgtttctgctccctctaacgctttctttctttctttttttttttgttgagacagagtcttgctctgttgcccaggctgaagcagtggcaccatctcagctcattgcaacctccacctcccaggttcaagagactgtcatgcttcagcctccccgagtagcagggactataggcatgtgccaccacgcccggctaatttttgtatttttagtagaaacggggtttcaccatgttagtcaggctggtctccaactcctgacctcaagtaatctgcctgcctcagcctcccaaagtgctgggattacaggtgtgagccaccgtgcctggccccttctaactctttctatcatgatactgtggaatttggataggagaaccagtatctccctttttcaagatcagctgtaggcatgaatttttgctgctgctgctgctttttttttttttctttttcttttttttcttacagaaacagggtcttgctatgttgcccaggctagtcttgaactcctggcctcaagcgatcctcctgcctcagactcccaaagtgctgggattacaggcatgagtcatcatgcctggtagacttttgcttcttgaacttagtatctgagatctgagaagtagttttctacctttttcccttaaaaattccaagctaatgatgggttgctttagtttgtaaggaacgccaaggacagggctactcatttgactcaaatctcatcatctagtttaagcaaaacttctcctaagcattctgggactaataagctgggaaacttaaaacatggcatggacactgtacagctgtatttttttttagatttggcttaccttttctctgagtttttcagatcagcctctgctttcattctaaccacccatatacactggctctgcttttctaatgatagatagctgccaattttctgtacataaagattgttggcttttgttccctcaagaaaagaatgggtaaatatctcttggttaacaagcaagtatgataatagagaggttaactccctgaaattcattctaacttaaaattttgtggtgcagaaacaaactgcaagggtggcacatgctactaaagaaccacaagagaaagggaatgtaagatattcttgagattttctaagaagttgaggaagcattttagaaagatacttcatttaaggatacattaagttcgaatagcatgttctagctgcattatgttctgtgcagccatgttggggaaaaaaagttttgctttagcatgtaaataacaagaaatcatgtctaaggccatttagttaaaataactgtcctacccctaaaaactaagagcattaagctgccttggtataaacttagagaaatgtgggaacatctgccccatcttattaaatcctaggtggacttagcagtggccaagcttcagagctctgtttagagagaatgttctagcaccacctacaaattgcctttctttaatttgtgcaatttaccaagagacatatattataaagtttaataaaactgtatgaaaaaaagctcatggtggtaattgctgtgttgatttaaagtcctgtaagtgcagtgaaacatagttaccatgcatataaatgctacttaatagctatttaactagagattttattcttatttggggcttcctcttaaatcccatggcttgtaattttagatactgcagatctttgatatagaatatgaatataattgggaaaggggaaggagttgcagagatttgggtgttattatcgagagaaaaccactcaaatgccaggccagcatgaaattgtccctgacttgttccaagaaagaatagtttggggagaaactatctgaccactttttgtaaggtgtgcatctccacaaaccaacctctttttttttttaccccttctttctcaaatatgagcagacctgaaacaggtcttagttagaagatatttaagttttgtgcttggtgatgtgtctgtgtcagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacaggtacaatactcaaacaggctcctcagagttttgatttggtcctacagataagacactcgtccttgttatagaagacccacactcacaaatcccattggttcacctggtgggattatcctctataagattaaatgattgtatgaatttgaaaaacttcatctgccttataagatttgcctatgttctctatcatggatgttataaaacccttaaccatttgtcatgtattggtaagcactaacagatgccaagtgaacctgactccagaggttattctgcaatttaggctctttttttagagggctcgtgggttatttcagcaatctaatctctggtctgatgcgtcctttccgttttcaccataattaaactactcattggcaagtgaggaaaagagaattgttggatttatgtcaccaacttctatgttaaagaaggaaaatttcaacatagtatagtggcatgagcactaccatcatcagtgtctatcatatttatctattgtgttctgtttctgtttttatcatatttattgtgttatctattatgttgttccctttccttcaaagatttcagggtgtcatatattatacaagagcaaagtggcaaatttaaacccgttttcaggtaggaaaactgagaatgtaaaaatagaaagtgagtcagtacactaattctgtgaaacagagaattcccttttaatcttttttactacgttggtttctaaatatttgggctctttactatgatactgaaattaggttggttcaccattgttcacatttttgaagaactaggatattttatggctttggcctgaattcaagaattgcatttcttctgattaaaggatgaacctgctccagtatacataaacaagggtttcagtctattccgtgctttgggtgccagggagagattatgtgtctcttgtttttatctatatccttttaaatccaggaatagagtcaggaaaatatatttttcagtcttttgaagatgaatttttaaaaatctcagtttggacagtagtcagaatgacctttcattttgtgctttgattcctagtgaggtggctagagaaatctatcctatgagaagtgagcagttaaaaacagagagagagagtgcgcaagagcgtgagtggtgaccaagagaaagagtgttcaatattttttgctgtatttgatgtttttttagtgcaactttaaagacattttcagtcaaagctttcaatgggtagggatgtttttaattaacttctacaatagcttcaaggcaggtctattcttgtgaaaagtaagatggccacttgagattttaatgtttttgataaatatgtttgttcttcataactactttctttctttttttttttttcctttcctttattaggaaactctgagatttccctcatgctagctaatggtgacacaggagtgtgaaaggcacagatgccttcaatcagggtttagtattacacatggtacaaaataagcacacaataagcatctgaaagaatgaacaaaccaccttcagcctgaaggaaaacgctttttacctagggtcctgcatattttaaaagccctgaaggaagaggtcttctacagactcttcacttgagagagttcaagagctactgccatatgggaactaacttttgagcctgtggctagacgtgggaactgacaaaaggagcagcctccaacccagttctggtgctcctaatgcctacatggtgcttattgtcaaactgtttttccctttctttaatgaatcattgtatgaagttaatacagaaccatgtctgttattcgttcatttgttttttaatttaatattgattgactacttatagtatgtcaggcactatgcgtataaagagaaaaagcaaactgtactcaagaaatttacatcacaatggaagaagacaaatgatttgtttctctgtggcaaatatgtgctattataaataaatacagtgttctaagggagcagactatgggtcagaaattattttctaaaataattttgatggcttctggtgaaaggtgtgtgatatataaaatgtgtacatattttcatgaacttctaaaacatactttacagtttttagttactgcgttcattatagtagaaaatggaactaacatagatagttgagtattcaggaactcctattactatcagcctcttgccctagcacatcatttattcattctgccaataaggaacaaggttgattggcttgagttttatttttcattttccttgtacagtctttgtagtataggctgtaatgaacactgatgtcaggcagtcataatggggagaagagatttgggtaatccattgcataagtgaattgatttccaatgtgcagtgtaagagaaaaataacattttaggctgggcgcagtgactcacgcctgtaatcccagcactttgggaggccaaggcagatggatcacctgaggtcaggagttcgagaccagcctgaccaacaaggtgaaagcctgtctctactaaaaatacaaaaattagccgggagtggtggcaggggcctgtagtcccagctactcaggaggctgagacaggagaattgctagaacccgggaggcggaggttgtagtgagctgagatcgtgccactgtgctctaacctgggcaatggagcaagaatccgtctcaaaaaaaagaaaaataacattttaaaatcatctttgggctgggcatggtggctcatacctgtaatcccagcactttgggagaccaaggtgggaggatcacatgagcccaggagtttgacactagccagctcaacaaggcaagaccctgtctctaccaaaaaaaaaaaaaaaaaaaaaaaaaaaaagaaatagccaggcatggtgtcatgcacctgtagtaccaactactcaggaggctgaggcagaagtatcacttgggccccagagtttgaggctgcaatgagctatgattgtgacaccacactccagcctgggcgagagagtgagacactgcctctaaaaataataaataacacctttattgaagtgcaatttacttataataaaatggactcgttttgtgtgtgcagttcaattcattctgtcaaatgtatacaccgtgtaagtactatcacagttgtggtagatacatcactgcagaaagttctcttattcgcctttgcagtcaaaggtagaagcaccaaccccggccttaggcaaccactgatctgctttctgttactatagattagttttgcctatcctagaatttaaatcaaacagtgtgtactattttgtgtctagcttattttactcagcataatgtttttgaggttcagccatgttgcatagattatgtgtatgttccttttcatttttggatagtattccgtttcatggatttttttttttttttttgagacagggtctcactatcttgcccaagctagagtgcaatattgtaatcatagctgaccacagcctcgacctccttggctcaagcagtccttccacctcagcctcctaagtagctgggactaaaggcgtctaccaccatgcccagctagtttttaaatttttttagagacagggtcccacaatgttgcccaggcttgtctcaaactcctggattcatgggaccctcccaccttggcctcccaaagtgctgggattacaggtgtaagctgccatgcccagccccatttaatggatttatcgaaatttttacattcatttatcaaaatgtttatattcacagatatgttttggcaggtaaggtgactaactgggagctctgacatgttccaaggaaacaaggctttccagagtttccatcagatatagctttgactagcaaggggcacccccaaagggcaggcaatatcttgacactgttttcatttctatttcatttggggatgggtgactgccaactcagatattagatggttctttatgaattaatgggaggaatgatgagaatagaagtctctattgagtaggagagagtaaactaagaccacatgcttgtgatgatagtttacaacgatttgtgtgaggagttacatgtatatttcctaagtccatattcaaattatggatattaaaaaagactggctgggcatggtggctcacacctgtaatcccagcactttgggaggccgaggtgggcaaatcagctgaggttaggagtttgagaccagtctgaccaatatggagaaactccatctctactaaaaatacaaaattagctgggcgtggtggcgcatgcctgtaatcccagctactcgggaggctgagacaggagaattacttgaacccaggaggcagaggttgtggtgagccgagatcgcaccattgcactccagcctgggcaacaagagtgaaactccgtctccaaaaaaaaaaaaaaaaaaaaggactgaaactctagttctcattttcttttctttctttcttttttttttttccttttgagatggagtctcactctgacgcccaggctggagtgcagtagcacgatctcggctcactgcaacactgcaagttctacctcctgggttcacaccattctcctgcctcagccttttttttgtatttttagtagagacggggtttcaccgtgttagccaggatggtctcgatctcctgacctcgtgatctgcctgctttggcctcccaaagtgctgggattgcaggcgtgagccactgcgcccggccctctagttctcattgtctaattttccaagataacctgttgatggacatttggggttttatttcctagtttgagctattagtagtaataaagctgctgtgaacattcatttacaaatctttgtgtagatatatttttatttcctttgggtaaatacgtaaaagtgtaattgctgggacacagtaagcatatgcttaactttataagatattgacaaactgccaaaatatttgtaccatttaaatttctgccagcaatatacatatgtagctagattgttttctccaatccccttcctcagtgcacaattatgttgcttaactatgaccagcctgtcttcatcacaaagcttggccaaaccgagtctcaaggtcttgtctctcttaacagacgagaaatgtagttctaggaacctgctgcgtttaccccattttcttattttgattcagcttacttgctctgagtacagttttctcatactgtacccttgccttacttaacactttgaatctcttaaaacattattgcttttactgacacattcctaagacattactaattctgcttccccccgggtgacttttcctattgatcttgtggaagaggactgggagctccaatctctgggtctttaaaacagcctgagacatgttttccccagaacaggacctgattgacaaattagcagaacattcattcctctgagctaaggggctaaggatttacagatgaactgtacccacgatttaggaaggtacttaattctattcctgtgcatatatatcaggtccacaatctattcattaatggtagacttgtgcttattttgtaggtctgaatagatatgtaggtatacacatacccttacatcccaatctccatttgtattcactgcactgggaatttatattttatgtatccatgcatgaagtgcctagtttagtgttatacaacctctgggcactcaataaatattaattgaattgaaataatggcatcctttataaatattcataagcaaataaaactatctaaatatatggagtatgaagcactcctctagaaatatttgagttaaaatgattaaaaaccagtgtagtgatttcattatgtgacaatataggtattgcaggagctattcactagttgtagacagcatcttgaggagaagtaaatacatgtatatatatatatatgttttttaatatacataatttaatataatatggttattttactatatgtaaaatatgaggctgtgtctcatgggctagtgagaattaactatctagatggatggatgaaatccacttctggcagaaatctttgaagcctttgcatagctagtaatacttatgaagtaccatctaatcaagtgggttaaaggactaaagcacagatgatatactagagtcttgatctggccttctgccattgaggaaagaagagaattatctttactgcatagctgttcttcaacttcaataccagggctgctcagactggttagttgatgtacttcatttctgagtatatgagattcaactcactttagatggctagcatggtcagtctgtctttgagatgcgaaatgtgcaccgtgctttcttgtttatttcctttttttttttttttttttttttttttttggatacagagtcttgctctgtcgcccaggctggagtgcagtggcgcaatcttggctcactgcaagctccacctcctgggttcacgccattctcctgcctcagcctcccgagtagctgggactacaggtgcccaccaccacgcccagctaatgtttttgtattttcagtagagacaaggtttcaccatgttagccaggatggtctcgatctcctgacctcatgatcctcccgccttggcctcccaaagtgctgggattacaggcgtgagccactgcgcctggccttctttcttgttgatttcaactaatctaaaagtgagagcagttatggtatatggctggttatatatatatattttttggagttggttaatctgtggagaggtgagagcaccaagtacccagtgttaagaggcatatctcagctactcaacctaccaaaaatgttttcaaagagataatatttgtgcaaaaaaagcccctctaggcagctctctgatttttttctgtctcttaactccccatgccatttttttttcctgcagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcaggtaagatgcctaactggagggtctgacatgttctaaggaggcaaggtttccctgaatttccatcagatgcggttttggctagaagggggcactccaaagggcaagaaatatcttgacactgttttcatttctatttcatttgaggattggtgactgccaactcagatattggatggttctttatgaattaatgagaggaatggtgagaatagaagtctctattgagtaggagacaggagagagtaaactaaggttatgttcttgtggtgatagtttacagtgacttgtgtgaagagttacctgtgtatttcccaagtctatattcaaattatggatattaaaaaggagatctgatactttagttctcattttccaatataaacctggttcctagttgataccctagattaatatgatgagaatcaatatagatagcatagacaaatggatatagagttcatggtacacagtttagagtataagttcttttgtgggagatttgttatagctgaataaaaactagcatgagaaaatatgacattatgaatctcagcctctatatgaaaacaaattctttcaatctgtatggtgaatcatctctatgctgcagatttttcttctatcaatagaaggcaagaaaagtgtatcaccagtagaaaatgcaaccagtaaagaataaggtatcaaaagaatactgaatttgtcctttttaaaaaaatctatgaatataggatttttccaagtctcctagtcaatactaccagtattaccacatttgaattttagtaaagtaatatatgtagtcgtagtaaatagtctgtgtagaattcctgtgttattcacaaatacaagagattacctttatgcaaccatttgtttacaagttctgtctcctgaaagataccttcattcggtatttcccttttatagcattgctagcctaaaagctgagtgttacttctgtttcccaatgccagtgctataaatataatataaatcacattctatataaatataatataaatcacattctaagtaattcttcctatataataggcataaacacagtgattaggacacataggtatgtatgagtcacttgggattcaaatgttgctttgaggcaagcaaagaaagagctgaattagctcccacttcacaaaggatttacttacaggaagttggaaatggaaatcataatattttttaaatgaattggtatgtctgtgtcaaaattgagcagaattgatctgcacatttacaaatagtcacacacatctagtgagctaattcctgtgtatggtcctatagctatgaaaaatattagaaagaggtttcttccctggaatttctagtagaagcttcattctggccttcttggattttctttttattagctgagcgtcatgtcattttcctggatattcctttgttgtcaagtttctttaggattttccttttctttgttttaaggagtcgatgctacttatttagttttttaattttaatattcctaggatagtgttaggtctttcctgtttgttaatgctctggtgctgatttggaatcactcagtagtttgactttttggaaaagtgcctgacttttggcatgtaaaaagtaattacaaatctattttaactgagaatgggagctggagaatttagtctaatgtttacactctgcagaacacttggaaaagaaggcaaaaccagattgactgaatcttaataattatttttgtctatattgaaattattgtgactgattagtcaaacttcttttctccactagtccctgatcaaactctgggagtctatgtccactcaagcatttcttccatctccccctctgccttctgacatgctgacttacactgaactggtactggatgatcaaggtcagctggtccacatgaacaggcttccaggaggaaatgaggcaagtagttgaaaccccccttccctttcttatctctgtgcccactagtaccagctttctgtgaggtggtcattaaatagcactggagcatggtagtcttgttgggagagttctttagagagagcattgactgagtatcaagaaattattaattttttaggtgtgataatggtattatgattttgctttttaaaatagtattgttttaacacaaaggactcagttttaaaaaaataaaaaggaatattgttttcttttagagatacagactaagacatttacagatgcaatgatttgcttctaaataaagaggtgtgagggtgggtgtgtagatgaaacagggttggtcgtgagttgatcattgaagctaggtgataggtacatgaaaatagattattttccctgtttttgtctatgtgtgaaatttggggattttctttttttcttttttctttttttgagatggtgtctcgctctgtcacacaggctggagtgcagtggctcaatctcagctcactgcagccttgacctccatgtctcaagtgatcctctcacctcagcctcctgagtagctggtactacaggtgtgcaccactacacttggctaatttttgtatttttttcttgagatggggtttcaccatgttggtctcaagctcctgagctcaagcaatctgcctgcctcagccccgaaaagtgctgggattttaggtgtgcaccattgtgcccagccaggattttctataatgaaaacatttaaagtattgttttgcttaatgttttttcttatttggattcatattaataaatgcatttttcagtgtcttttccatgctcaattcatttgatctggtgctgttgtgagcatgataaatgtgttcttgaaggggctcaatcagaattaggggttcaaacataaaaaatgtagcaaagaacccattttttgataattatcccaagaatgcattttctagccttggcatcctttctctcagagtaacctatgaatagtgatataaagtcctattttgccctatactcttatactcttgtccatgcattatgattctttctgattttaactgtgctcctaatgtacagttataacaatgataataccagtaacaaacctaaaaagagagatatttttatttcaaccttaaatataatccctagaaagatttcattccattgaaggagtaatctttacctgtgttttcaccacaaataggctgggtagacctttggaaataataagcagtttgtttctattttgctcaatctttttcaaaaaatttcactatatatacaaggtgtgtggctatttcagtaatatgccagtggatgccaacagtagatgatttggtatcaagatggatgcaagcattggaccagatggagagtatcagacttgtaggagtctcaacaaatagcaaagtcaagaggactggggtggaaggatgcaaaacattttgacaagcatagatatatactcatcagcacacgaagttgaaacagaggtttctgccactgtatgtagcatctgcctagtgagcccctcagcagcaaagaaaagcttcattgtgctagacttaaattctgattcattgaacagtgtagtcttcaggaatggaaggcacccttgtgaacatggggctgagagcaaaatggttttaactaatgtaattaaaacacaaaatgagatttttggccacgtgaaagctagctgcagtgctgtgtgaaaccccttgccatgatctttctttcctgctttctttctgccctcattctgtgtttgagcgaatggagactcagggaatagtgaagtcccagagggacagagctctgttcttgctgaaattacaagcacagagctgcctgggcatgaacatgtagtgtttactctgccagtatgaatacaaatagtcttattatacgggcctctgtacccaaagaccacacacacacacacacacacacacacacgaattttttaaaaattaaaggttttttttaacccctttaagacctaacaaaccttagtggaaaagatatgtcttaaacagttgcataggactatagctatgactagtagtagatctagtataggagccacatgttttcctttgtccagtgctttaatagttttgaaaccagaaagtgaatagtatttcttcaaaagattttgagtttttgtcagttctcactttcttcttgttctacagttttccctccttagttgcctattttctttgttctgtttttcttttcaaatgattgactaggattgaggctgagtgttagcttgctgtttctgagcctttgagcttgggaggagttagactgatgttcttttgtgagcagttagtgactaatgcccaggatggctggtgaagtcagtcattggccttagctagattatagggcactgcacaacaggaatgaggttggggtgttagtatcaaactctgctaccaatagcttgaacatacaatggagcatgtccactgagagactgaccaatctaaggatggagtttcagcagtcagaactctgagggacagctgtgcctaagagatgacaaagtgtcagtaggatgtatttcctcgtgctgagcccagttttatcagggcaagttgactttcagctattgcggtttaattttctttggccaaagagcaagtttgtcatgagcctggcactctacatattaccccaagaatgatgtgaagggaatgaacagagctcatgctgatgagatttggagtaaatctgtcctgtcccaaagagaatgggcatctggacagagccttgagaaatagttttattacaaaagaataaaaaattgacctgttaatgttctgaaagccaaggctcaatgtaaatgcattggtgctatgtagacattaaatcatcataatgtggtgttctccaaaagtgacggctctaccaggtcatcattgtgggtggtattgcattaccttcaaggattggagtttctgagtttgaaaactagcacatggatgtaaggagtaagggtaaaatgagagattccttcagagttttcccatgaattgaggtgcttttctccatgatcgaaggcagaaaacctgcacttatcagaccattggctgtatgggtggccagtctttctaatttttttttccaggacagtaaataggtaaaaaggtgatgggaccaggacttggaccaattcagttccatttagttttaggtaacttctttgccatttgaggaggaatattggctgtttcagtagagatgtgacctgcattttgaacatttatgcctgtgtttagagcaggagacagagcttttctgatgctgtattagctactgtctcctttctattttcctagttgtcccttccccataaagaaagatgtaactaaaggagtaccacctaatgcatgatgaaaggtataggagaacacatttttctcattgtcatatttgaatggcattacatttagtatgactttagagtaggaataaaaaagatgtagactaaatctgtgaactacgttacttgcagatagctccaaagatgagttgtccaagatttttcttaatagtttcaagtaaagatgaaaattgaggaaaatgtgattgcagcatagactaaacggatctcatttctagctgctgtgttggtacagtgatgggcactgtatgtaaatacacagctagatgaatgtgtgctgttgagcctggatacagaagaaatgcagctatccaacagttctactttaccacttctcaattttggaggaattgttttcattttcctgccagtttactaacctgttttgatcttttggtggaagctataattgcaggtggggacattttgagtaacagttcgcaatccagtacagctgcttttcgcactaaatcctgttattaaaaagctcaggctaagatcaagccaagggctgtaacggacttgacagagaacaacttaactttgcctggtaggacaaagaaaatcctagccttcttgagactatgctcttgtttattctgaaataagttactagcattcttttattttatttctttttatcagctctgcgaactagaccagtaatctctaaagtgggcaatgctgaaagatatgttagagagtcaactaccatagtaactttagtgctagtagaaattaggaccctgtttttcttactatatcagaacatgggcagctttttaacattctgtctcatcatgcctgtcataatgagaaactgagatgagaagacgatgttgcgatgttgtatttggaagcagttataataattaggtacaagatgtatatccaaaaaaggggttggtattcagagactggaattcttggtataaaagtttttctgggaggaaagtatattgaaaattgaatgcaactggggccaggcgtggtggctcatacctgtagtcccagcactttgggaggctgaggcgggcagatcatgaggtcaagagatcgagaccatcctggcccacatggtgaaaccctgtctctactaaaaatacaaaaattagccaggcgtggtggcgggtgcctgtagtcccagctacttggcaggctgaggcaggagaatcgcttgaacccgggaggcagaggttgcagtgagccgagatcgcgccactgcactcaagcctggttacagagtgagactccgtctcaaaaaaaaagaaaaagaaaaagaaaaaaaaattgaatgcaatttgatggtcacctctacacacactaccactcttaagaattgtggtagctctgagccttcattttttcagatgggcgctaggtgtcagggtttttccttctcagcagcttagcattcacatgagccttgtgagtggccttgtttgttgaggcagattcactggtgtccttcttttttcagttggtatagtagcctttacctagtgttcctgcaataagcaattgcaattttaactctttggttgaagatcctttgaaccttgcattagggatctattttttttttttaaagaagaggatgattgaagaggaaataaagtagtgtaaattaaagtttaaagactagctgacagccaggcgcggtggcgcatgcctgtaatcccaacactttgggagaccaaggtcggcggatcacttgacgccaggagtttgagaccagcctggccaacatggcaaaaccctatctctacaaaaaaaaaaaaaaaaaaaaaaaaaaaaaaaaatatatatatatatatatatatatatatatatatatatatataaattagccaggcgtgttggcaggcgcctgtaatcccagctactcaggagactgaggcacaggaatctcttgagcccaggaggtggaggatgcagcgagccaagatcgcacgactgcactccagcctgggcgacagagtgagactctggctgaaaaaaaaaaagactagctgccatcatgactggtattttggttttagtcctgctttatgttctcaggggtgaaatggtagggacagtggggattaggggttcagttttagaactgctagcccaactaatacccatatttaattattgttttaattgttggcaatgtactgatatcctatgtctcccaaagtatagcatctcattaatttttttattttaaacatataaaaaaatacacagtgatatgacaaatacccctgcatctactgaccagcttaaacaaatcttaccattttgactgggctcctcacttacatgttactataatcctttgaatctctaatttgagtatcaaaaaaacaatttaggagttggtagggaaaggaagttggtaagcttatataagcctaaaagattagaagaaattaattagtagatccattttgacagttcttaggctggacctcttaacccaaaggacctcttattttagaaaaaccaccataaccctctgtcttaattcacttggttgacattttccataccctcaaaggaattgcttgggttatcctggactcagattctagtggaaagcattatgttctaaaactctgcctgtagagagtgtgtatatgcttacgggttttggtggtgagaaaagggtaggccatttctcatgaacacaggacccaaatatttaacattagattttttaaattgttttactcaatttaacctcaaaatagctccatgaatgtgatgctaatttggatgtactttaccttgcttttgtttcattcttttgaaatcagtttgccttttcatgctgtgtatagaaattgagtcagtgtcagtcttttagatatgtgttagaaaagaggcatatttaaattgtactatgctgaaggtgagttctgaaatagacctaagcgaagcgggtctgtaaaacaggaccatggtctatgcattgattgttcaacttataaaaagggtctttgccattaatctgtccctaaagataggagaatgtttataagtgctttgggatcctcagcagaaaagggtcaaatacatatgattatgtataattatgattatccataaatgattatgattatacataagtattcataatttgtgcttgccttatttttcatcaaggctttgaaaaatcaattttgaatccttgagattaagtatagagaaagatatattatggcatatatggtaagataattttatgttaattctatgtttttgttcttttattcccattctaagtaagtatatttggctgcaagtctttgtctaaaatgatcttccaaaccaaacttggatccctcattagaaaaatatggaggctaattttgaaaaataagtcttcctaccatggaattacttctaatgaatttctgacactgttcttttgggatgtatatacttttctcagaattccttctgaatgactattattggtgttggagatttctcatcaggttgagtagtttttactcatttttttgatagcaaaatgaggctcagtaaccttgattgactttgaaaatcctaatgcatccactggctcactaaagtagtacttgtggagggctcctcagtttctttcaaaaataagtctagagatagccttcaaacaaaagaatgtacttgccagcatatttatacctgtcttaagttgtaagattttactgaaaaagaatgtgacatagtaccctatgtcaagaaactttacagctccaaccagaggcaataatgaacatcaggacagcaacagatgacaccagagaatgaggagtagcggggggcaccagagttcagcactcattcgtatgattaatggacaaggcttctgggactatagtaggccaacttggttaatttccataccaaccaattaatcctgggccccatttctcaaataccgctggcttctatgtgctccactgcatgtttgttaaaaaataattcctatgcttattaaattactgtgtgtacatgtgtaaaattactgtggtttcatgtatataaatgttacagggagaaataatttccctgttcaaaattgttatttctaatctttgataacattttcaaagaattacctctgggatgaaaattttttgctctaaaagttatatttttcttacccttttatcgctgtttagagaggttgaggtgagtttgttcagccatttttgaagtaagccataaggcttaaaatacaatatttgacttaatttgtgccatttggaaaagccatgctgaaaaatatgtcaatgcctttccatattgtattatttgccagatatcaatgttctattatttagtgttctgtgatcatgtgaaggagctcaaaataattttcttaagagctgaaaaactctttttttcatgcttggatacaagatacaaaagggggaaagaggtaacattttgttatatatctgagaagggactcaagttcagattcctgctctctggatcttagttttctcatctttatgatgcagatgatgcccaagtctgggttagcgctaacatgcttggattctttgtattgctgctcaagggccttgcagggtagtcatcttcctggcattagcagaattagaacaataggttttacagactcttccaaaaaaaactcaagatcattttagcatgaatatagcaaggcttttagcatgaatataacgaatacagcttcaacatctcagccacagcctaacctgtatttaaatctgtatggaaaggtattgttagagctcaagtcaaagtgtggagatgtaagaaaggcagctgtggcaaagatattctctttctgcttcccacagcatagctagagttgatggatatgtctttcacccttaaaaaacaaaatcctggcatgttttgcccttagcttttcctgcaaatttctttgttgagcttaatattgttgttttattttgtagtaacaacagcagctttgggaagtgcctgtgtgtgcttgcacattctattcacattgatagtacaattaatgttgatgtcaattttggtgttaattttgggtcatgattagtgttgacactttgtgtcagactaatggcatttatgggcaccatcagaataaatgttaatattatcatgttttcactatctgttatagtaacattaaaccaaggtcctcccagcagaaaaaatacatatatggatagatagataatgcctttctgtatcgctggtgttactcagcgagaaaatgacatctcagggcagaatcctaatcactgtttggagcatcagaaataatgatcacctctgatcggaggttgtgaataattcatttggtttgattttcacgtcctgtccagtgatacttttcaaaccaaatgtgtttctacaggaaaataatggtcccacttcttatggaaatactgtggcacaaatcattttacccacataaaaacagttaaataagactgttctcttctgcttgctttctccttcccatcccctcctccctcacttgagctgttcattccagaatcagaatgtagccaaagaaatatgttctgccttagaacttgtataagggaaacaaatatttatttctgcttatccttagcttattcactgtggctcttttcatcctcttccctttttcactttaagataatcagcttaggttgataaccctaaacctaataaacctgctcgttggaatgttctgttatgaaaaatgatctgaaattaaatattttaaaacttattcatggctatagtaatgacaaaataatttgtagtaagtacctaggaccacttgtttagtcagtgcatgagagaggcagtgatcagagaagacgacactggcactgcccgtttgagtctaaaactcattagaccataaacccacccacttacatgcgggctacagggtacctttttgttaatttcttagctcttccatcttccttcagctcttagtcctggcatgtcattttcactgggtttcacctggataaaaatgttggagagaaagagaagacccccaaaaagagggatttaatgatggggtctccgttagtcattattcttcaattaatatacatgcagattgggcttaggtgaaatcaatgaatgtcacattgctaatcacattgtcacactgtgtatacttttatagtgattgtagaattttcgatatgaaatctccattatgtatataatatagatagacccatctatagaaagtaatttgactgaaaaacttaacagtgtactaattagagagtgaaatatgactctcttccaaagcaatgatctaatcctttgagatgaagctattcttaggtagaatattttgaaccatttctcctgaatgttgtaacccttttttatttttcctaaatctaacaagggcagagggaagcatttttcaatctagttttcatcatcagacagaaagtattttgcattcagaaaccatttccagtatcaaattcaattttgtcaggtgattagttgagttgggtagagaataatttaaaaacacaaagctggaaatggctatggtgcttctacactggaggagagctgttgctattctcaagttgcaagcttcctctcagtgactgtgcatcacaactggattattgtgttgtatgtctttgcagctgttacagacctgcatctgttgacaccatgtgttcctacccaggactggtagaagaaataggggagtgggtgaatgagtaccttccctgcctatcagtgcaaacgtccttttatgtacatatgtttgtaaagttctttagccctcttcaagatgaaaggttctgtataaataaaagctttcgattttagtacatgtttgtaatacatgtggtacagtcctaaatatgtatttagctgataggcactgttcttgtctattgtacaaatattgactttaaaaatataaatatgtatttaaccatcagaccagaaaaacactgaagcagttacttctgaggtagagacattaatattgtataaacctatatatacatatgtttacactctaccacatcattgcagagcatttctttttagaaaatgaaatgataacccaacaaactaacgtagttcttgatatttctttctctttaaagtgagtcttgatttttaattttcatacatttatctctttcaaattttatataaataagatcggttgtagtatgactaaaatctagaattagttcctctaaaatatgggaaatcaattaggctggtgagatttttttccccccttaaatttttttttttgttatggaaatgctcaaacgtacactaaagtaggcataaataatataaactcccatgtacctatcacccagtgaagagtatttggtagttttcttttctcagttattttttattttataaaaagttaaagttatcaatgcaatataaacacaaaaaagaaaatttggagaatggaaaaaaaatacaatttcatcatcccaataattatcacctcattttgctgtttcttatttatttttgtttttaccccgcaaagtgcttttcaattgatgaagttgtcattcatactatgcacttactatataccaggcactatcctaggacttaacatgtatttaatccttacaacaaacttatgccgtagatttttattacccttgttttaccagtgaaggaactgaggtacagggaggttgataacttaccttagcgtatatggctagaaagctgagtctcagttctgtcaaattatcttagattcagattcagagtctcagaatgtggctcctgagtctgaacccttttctaatttagtattacatcatgggtatttttaaatgctattcatagtcttcatagtcatcatcttataaggctgtacagaacactaacagtgatcttactatccaatttacttccctccaaaataattttagattttcaggaaagttacaaagatcatattagagagttctggtataccctttcccagcttctcttaatgttaaaacactttatgtaaccatgatatgattaccaaactaagaaataaatattgatacaattgtattaaataaaccacagacctcttttttttttttttttttgccagtttttgtactaatatctttttaattaaggaacatacttccttaatttctctagtaaagaaaatgccatttcttggctgggcgcggtggctcgtgcctgctatcccagcactttgggaggccgaggcaggtggatcacctgaggtcaggggttcgagaccagcctggccaacatggtgaaatcccgtctctactaaaaatacaaaaattagccgggcgtggtgttacgtgcctgtaatcctagttacttgggaggctgaggcaggataatcacttgaacctgagaggcggaggttgcagcaagccaagattgcatcactgcactccaacctaggcacaggttgcagcaagccaagatcacgccactgtactccagcctgggcaatggcctgagactctgtctcaaaaaaaaaaaaaaaaaagaaaataccatttttgtgtatgtgaaactccttttaaaaaataagcactttgggaggccaaggcgggcggatcacaaggtcaggagttcgagaccaacctggccaacatggtgaaaccccatctgtaccaaaaaaaaaaaaaaaaaaaaaaatgcaaaaattagccaggcctggtggcatgcacctgtaatcccagctactcaggaaactgaggcaggagaattgcttgaactcgggaggtggaggttgtagtgacccgagatcacgctactgcactccagcctgggtgacggagcaagactccatctcaaaaaaaaaataagtaaacaattcacattagctataaggacaggttacttaattcctctgtgccttaatttcctcatggcaataattacagctacctttgaattaatactgactaccatttgagggcttttgtgtgccaggctctgtactagtttaacatggtgttgctcacaacaatacctccagaaaggtgctgtcatccccattttataattggaaaagtgaaactgtaaaaggttaagtgtccaaggttatacagctagcataaaactgagatttgaaccaagacagcttgactttgcagcttaagctcttaaccactatcagtagttgtcaacttttagaacagtacagcagatagtaaatgttcaattaatggtagttattatgatagctattgttatttttaaaataaaatagtttaagaatattcaggactcttattctatgattcctaaaatataagtggcaatgttctaagcccttggtgttaagtatttttcaagtgttatttttaaaagtgaggcagggtgcagtggctcacacctgtaatcccagcattttgggaggccgagacaggaggatcacttgagtccaggagttcaagaccagcctgggcaagatggtgagaccccatctctacaaaaaataaaaaaaattagctgggcatggtggtaacacacacgcctgtggtcccagctacacaggaggctgaatgggagaatcacttaagcccaggaggccaaggcttcagtgagctgtatttgtgccactgcactccagcctaggtgacatagcaagaccctgtcttaaaaaaaaaaattaaattgaaaaaataaaaagactctggaactagcaaacatttattactcccagactatgtttaatgttcctgggaagcactagaggagatgctataatcgttcaagatggtaagccaaaagcaatcctaggcagcatataattagttatcagaagaattctcaggctgggcaaggtggctcacgcctataatcccagtaatttgggaggcctaggcaggaggatggcttgaggccaggagtttgagaccagcctgggcaacatggtaaaatcctgtctctacaaaaaaatgcaaaaattggccgagtatggtggcacatgcctgtagtcccagttatttgggaggctgagatgggaggattgccttgagcccaggagttgaaggttgcagtgagccaagattgtgccactacactccagcctgggtgacagagcgagactctgtctcaaaaaaaaaaaaaaaaaattctctacacagaggtcttagtaggagatcagaaaagataggaattactttaggctgggagaagctttactgaggaaatggaatttggatgaaccttttggaatgggtaagatttggacagagtgagaggagaggagagagaaagacaaagttttttacgtagaagttaatatagtagatttctgcttctaatagtgtgtttatcaaacccatgggtattattttcttaatttcgcatgtggggacattgaagctcagtaaaattaaataattttcttaagatcacacagttagttaatataagtgatagcgcctggatttggatctaagtttgttggactccaaagcccatgttcacctttatatgccctatcctttgattagcagtgaaatctaaattattttaatgtaaattgaataatagtgctttcttagatgtttgtccatcatgctacctcaaaactgaatgtcttctgatcaggaatcttgctgcactgagactgggataacactctccattctgtaatggtactttttaagatggggggcggggcggggtggggaggcggtcgatgagcaacatactttggaaagacattgataaagaatagtgtgttcttggtgctgctgtgctgacacctaattagaagtcaatattgcaagcataatgacctagccaattgctgaacttgctgcccaagtgacacagttagagtccccaggtagtaatgaaagataagagtattatttgcctgcccagtgccacatggtcgcaatgtttacattagcacacaaatgctgaagtagattcttcagggcttgtatctaagctgcttctggcctatgtgcctagggttaatatatcataaaatttggtgtaaaacgcaatctttctaactacaaatgcatttagaggaaaattgacagaaaatagcttttcattcctgaaaaacaaaaggtttggggttagaggggcatgtgtgaaggcagataaagcatttctcctcatgcagggattatattaactagcttcttagaaaccacaaccaaaattatcctgatatttgagtgttcactgtgttattttttgaatgatctatttttccttcctttctctgtctttaatgagtagatagagtaataccttatcttagaaagtgattggatttttttctgtgtatcatatccattttgacttgtatttggccaatggtatgatatattaaatagcttatatttatctgagggtgtttcatatatatatttcctaatgctgagaatcacaaatagctgtgtagaatgcttcaaccagcctgattacagtggatgtgcaattggattgaggaatgtgtactcagagcttatgatcactggcctggttgagtctgggtgatgcatgtggctttccagggatgccgctatttacatctgttaatggcccttcttgatggccagctccccaatgaggtgatatgcagcagcctggggatgagggaccaaggctgcagatgtggctggggctccattaggcaggaccagggaagctcatctggtaggtaggctttgtgtttggtggcgagtggtgggggcaaggaggggggtgagagacagaaagaaagggggaaaaaaagaatggaaaacattacttatccaggtataggggaaacaggcaggcagacatgaaaaactacagctgtaactagcgtatgaatgaatagcatagaaaagaaatggaactagcaaatatacaagtagaaggattgactagttctcatatagaaggggattaaaacaggagagggctgtgagagtttgggaagagacatgtcacctctgccttttaagtcaatatcatttatttgtgtagctggccagatgctgctgaacagagagcagagatttacatatagtgcagcaagagattagttatttccatcctttggtttttctggtgctagaagaaagcaagagatgctcacaaggatgcaatgttgagcattggtaaattctagcagaaatggaacatacctgaaacaaatcagtaaagagtgtttctgttattcctatcaaatgctagaggacagtacaaggagcctggatcatgaaaagtgtacagtccgtgagacgtcatcctttttctgcttccttgtgtgttaaaggtttcttggaacaaatgtcacaaaagatggaaatagtgtctgtgatagtccatttgtgttgctataaaggaatacctgaggctggataatttataaagaaaagatgtttatttttggatcatggttctgcaggctctataagcatggcaactgcatctgttgggcttctgctaagggtctcaggaagcttatgatcttggaggaaggtgaagggggacccagcacatgacatggtgagagagggagcaagagagaggtgagagggagcaagagagaggtggggggcaaagtgctacactcttttttttttttttttttttttttttttttttagcaccgtgacatttttgagttaatttaagccacacctgggtgagagggccctgcacctagaagaaggtgttgggactcttggtggtgaagtatggcttatgctaaccatgcaggaccccatggggcagtgggaacttgatctcggagtcatggaactgtttgaccgccagctggcagcacttgctggccgcagtctccaccttcatgatctgggtggagtgggcctgtgtgtgatgccaggtgcccatgtctcactagcactggatgacagcacccatggtggtcaagtcctgatatccagtacatgttgtaggtgctgctacgggagtcgtagtgcagctagatgccagatttcttcacctgcaggggggatttctcaaacacctacctacagtagacaattttccctgaagactccttatcttctttagctgagataccaagtaccagagacgggacttgacaatgacatgattaggtgcaagattcgcataccatagaagggcagcatgtggcatttgggggtgggcaggcagcaacccaccaccttgtactcttgtagtgtgcccaaggcgttcatagcactctcttcatgcttgctttcacccacaagaggccacactctttcaaacaaccagatctagcataaactcagatcaaaggggagcaccaagccattcatgagggatccaccccatgacccaaacacctcacaccaggccccacctctaatgttaggaatcatatctcaacatgagatttagagaggacagacatccaaaccatatcagtgtcttagtatatatggcagtaaaatgagatatctagatttaatcaacagtgccatggcattcttccacatgtatcctgagtgcatttagattttggcttttctgtcttctttgagcaggcccaaagaaggaattgagacagttttgaaatacacagtagaccagctgttctcagcataatctagcagtatactagaatgtcttttgtagtttcccacagggagtttggctctttagcaatgtgtatctttacataatggctgtgcctaggtatactctgataccttcaatgaacctgaaaaaaattctgcctgtaagaaacttctgttcatttgtttgtttatgcctttccagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaaggtacacactaagagcatatactacttcaaggtgctatatggttatgctacatgtgtggagaggtgggggaagggtagaggtttaagttcaaaaatcaccacttatggtaaaaattaaatataaacaaaattatttgtgaaaattccttaagacaccatattaaagacaaattatttctcaatatgttcacttggtttttcttccatctataaaacaggttgctgtttctttggttgagcactagatgaaatagtaggtatgcatttagtgcgagacatgctaaatcaaaaatatatatctttatttaattgtggcttccaggacttacggtcaattatcaacaaaatcccttacctcctcatcttctgctccaacctccttgttcaccttgagatctgtctctcctctaaagatattgcttcccccgtagccctctgaagtactgactgatttctgtctttcttttgaaccactgagcctggaaggggaatattgtcctccttgatcctcattgctgcttccagacacctctcccttctctctgaaaaaatcccatctttgaatctcatgtcatcagactgtgccatacccatactgctccttgtgtttcctgatcctttggtcactccctctcattctttgcatcttttagttcctggcacattgccactctgtccattactaatagtcatgtgataattcttggtgattgctatatccacatagatgattcttcccataatctggcctcttggatccttgacttcttttcttctagtggttctgtcctataccctagctcagcctctcattccccataatctcaatttcaagtatctctttctttgctaccccctccatcctctctttccagcttcctctctctagtccaacaatcctttgaaatcatcagtaccattgagttgaactcacctgtttatcctcccacctttcttctgttcttcactccctccttacacctcatttcattcctatctggcttaaactccaaggtcagtccttgattaatcattataatcaccatcttttctgcaccttcaactttctctctcaacttgcttcaacttgcttctctcttcactctgcttactctgtgcttttacagagtgtttaaatccaactctctccattctgctcccatgcctgcacctgcccagctgaactttgatggagaaaaaaacagttctgttgactgatcttactttaaattcaagcttagcaacctcctggatgacggtttcacatctctcccctcaaacctgtaacacgcacttccctctccccactcttagctgatatcatcagaccttgcttcccaattttcaagaaaagagaaacaatgagaagagagcttctacaagcttccatgtacctgcatccgttgtgcccttactcttcaccttctcttccacactttgaatgaatagttcctacttctgtctaaagacaatccctcctcttgtacatttgatctcctttcttgctaacttaagtgtacgatcaacacttcctcctgctcttttgtgcatcagcactttttccctctgtactgtatcagcccttttagcatacaaacacccctccagtcactgtccctcccctccttccctttacaggaaaattgttttaaaggagttgttcttgctgtctccagatgttcttctcccattccctcttgaacccacttcacttgagcttgcacccttaccattccactgaagctgcttttgtcagggtcaccagtgattccatattactgaattctatggtgaattctcagtcttcaccttagttatttgacaatagcattagcatttgacacagttggtcattccttcatccttgaaatactttcttctgttggcttccaagagcccaaagtctcctttttatcttcctgcattcctggctcctctttctcagtttcctttgctgcctttcacatctttaaatgtaagagtatttcaggagatgatggaaatattctatattttgattgtggtggtggctacctaagtacatacatttgtcataactcatcaagttataacacttaaaactgatgaattttattgcatgtaaattatatttcaataaagttcatagaaaaactttattaaagtatgggaattgatccagtacaggggtttttctggggctgatgaaaatattctggaattagtggtaatggttgcaaaacatctgaatatactaaagtctactgagttatacatttcaaaatggtgaattttggctggttgcagtaacccagcacttcgggaggccgaggcaggcagatcacttgaggccaggagttcgagatcagcctggctaacatagcgaaataccatctctactaaaatataaaaaattagctggtcatggtagcacacgtctgtaatcccagctattcgggaggtagagaggcatgagaattgcttgaatgcgggaggtggaggttgcagtgagccaggatcgtgccattgtactcagcctgggtgacagagtgagactaaaaaaaaactttaaaaaccaaaatgtttaattttatgttatattaattttatctcttttttttttaagagacagggtctagctctgtcacccaggctggagtacagtggcacattcatagcctactgtatctgccaactcctgggctcaagtgatcctcccacctccacctctcaagtagctgggactacaggcgcacaccactacacccagctaattttattatttttcataaagacaaggttttgctgtgttgcccagacttctctcaaactcctggcctcaagtgatcctcccaccttggcctccccaagtgctgagattataggcattagccactgtgcctggccagtttttttaattataaaaaaaagtgaatggagacatgtcaggagcacagaggctgcagcaggaccaagaagttctggactccccattctcaaccccactaggacccaatgccctctcacctggtggtttggcaagacagccaatatagaaagtagggtagaaggaaaaaagtgattcaagggcttggtccctggactactcctcttttcctattcaccttcccttggtgatctcatcctgtttttttgttttgttttgtttttttgagacagggtctcactgtgttgcccaggctggtgtgcagtggtgcgattatggctcaatgcaacctctgcctcctgggttgaagcaattttccagcctcaccctcctgagtaactgggactacaaccatgcaccagcatgcctggctaattattttggtttttgtagagatggggtttccccacgttgcccaggctggtctcgaattcctgagctcaaagtgatccgcccatcttggcctcccaaagtgcaggaattagaggtgtgaaccaccgcacccagcctcatccagtcttttaaagctttaagtttcatgtacaagctgataaacttccaaatttatatcttacccctgaacacaagattcatatatccagactcaacatctctacttacatctgcctaaatgtctgcctaaattgtagcttctaatcttcctttaatgtgttcttcccacagtcttctgtctcaacagatggtacctctattgtttcatttgttcaagtaaaagaccttggagttattcttgacttctgtctttcttgcacaccccacattcacttccacaccccattcatccatctaaacagtaaatcatgtttacatccctaccttaaaatatatccagaatctgagtacttctaacaaattccacagctacttactagcagtagcagtagtctaactcttcttacctgcatattgcagtaccctcctaattggtcttcctgcctctggccttgctcccagccccacccaaggtctgttctcaacagaatgtagaatgaggccatgtgtggtggctcatgctcatgcctgtaatcccagcactttgggaggctgaggcagatggatcaacttgaggtcaggagttcgagaacagcctggccaacatggtgaaaccctctgtctactaaaaatataaaaattagctgggcattgtgacagatgcctgtaatcccagctacttgggaggctgaggtgggagaattactttagcccaggaggcagaggttgcagtgagtcaagatcgcaccactgcactcctgcctgggtgacagaaggagactctgctcaaaaaaaaaaaaaaaaaaaaaaaagatagaatgatctagttaaaatataaatcagatcacaaaatttttctccacttaaaaccctttaatagcttcccaattcattcaagtaaaagccaaagatcatatagttgcctacaaggccttacatagattggctttccagtaccactctgccctcatttcttgctacagcctcccctgaccattccacacattggctctacccgactctgctttcttaaacctgcgaagcacatcatgcctcagtgcatttgtacttgctgctccttctacctagaatgctttttcctcagatatcctcatgtctcatagcctcagctcctttaggtctttactcaaatgacacttttcaatgaggctttccttggttattttttctaaaagttcgactgtctaccttctctttcattttgttttccttaaacgttattcccatttacattatacattttacttattttgtgtatttcctgactttccgagtaggaggtatgtttcataagggtaggaattcttgtctatttttgttaattcctgtttttccagtgcctggaatagtaccttgtacataataggcactcagtaaatgtgtactgactgacatactaatgacactcagtgctgtcaggcattctcaacacaaatcatgcaagaccaatcgcagatttatgtcttttccatgttgtgctcactgtgggacatacatttattgagttaaatggtgggcataatttctcatagtatttaaaatgcttccctgtgtttacttatttttttgactgagtgactaattcacttaagttaaacacatataccatgtaactctactttgtatgtggctgtgtgtatagatacatataaatcaattatgaaatgttagtataattgtttacatgtaaatgggcattaggagttgtttattgaaaaaacaaaagatctgagttcagtgttcactattagcactgtgtagacttctgattttaatattgaatctcctagatttgcggttttctgttatcccttgcttatatttattttgatgatcctgtggatttgagagagtgaaaaatagtaattcacacaattctttaattacatgttgatatctttaagagatgtcactaaagatcagaaaatgaccctttaaccctgttgaaaatgaaatgaggccgggagcagtggctcacgcctttaatcccagcactttgggaggccgaggcgggcggatcacgaggtcaggagattgagaccatcctggctaacacggtgaaaccctgtcgctactaaaaatacaaaaaattagccaggcgaggtggtgggtgcctgtagtcccagctacttgggaggctgaggcaggagaatggtgtgaacccaggaggcggaacttgcagtgagctgagatcgcgccactgcactccagcctgggcaacagagtgagactccatctcaacaaaaaaaaaaaaaaaaaagaaagaaagaaagaaaatgaaatgaagggaatatacttggaattgcagctataaggtgtcttgtttcaaggacagttagtgagtgaaaaaataggcacttcatctttcaaaggaggactgtctgtgctagtattctgttagacagtaaacctaagaagtgatgtggcaatttaaagctagctgtggaacaagcttcattatgtatgctttgctgtatcttctgattatatgacaatggcaaataatgagttaaaaactatttgtgcttcacagggatacaggtatttatatctgactcctcaagattataagagagtcagtgctctcaactctgtccattgtgaacacgtggaagatgaaggagaatccaggtaggtatatatgtattggaataatttggtcatgactaaagaaaggagaatatggtatttttttccatattgtacagctgttcataaccttgaagaacattgaagatgacataatctagatgttttaggtttacatccagctctaccacttattagctgaagaaccttgggttattgattgaagtttttaaatttataatacttaattcattttagaaaaactgaaacatgtaaacaattataaagaaaaaaaaattagccacaatcccaccttcaggccacgattatgaatttatgttatacacttgctgtcttttctatagacatatcttttttctatgtgattgagatgataacaagaatttcttttataatttatccttttcactaaaaactatttttggggaaatttcgtgtattcttaaaacattatttaagaatatgatgcttaatgtctacatagtattttattataataaatatatttgaacattcagactatttctaatttttcacatcccttggctgaacccacttaagggacatttatataagtttcatataaacttttaggaattaaaagctctgatcatccctttttggttaatttctagaagagaaattgcaggtcgaaaagtcaatttttaaggattttaaaaaataattttaaattgccttcccaagatttgcatttctgtcagcagtgtagaataggatttgtttccctctttaatttttcttcacccctgccaacattgattatcaattaataaaatggaataaaaatggcaattgttattttaacttgtatttttgactcccagtgaagttgaatgtttttatataatctatctgcaagtatttttaagaatgttaattgcttggctgggcgcagtgtttcacgcctgtaatcccagcactttgggaggctgaggcaggcagatcacttcaggtcaggagtgcaagaccagcctggccaacatggagaaaccccatccctactaaaaatatacaaattagccgggcctggtggcacatgcctgtaatcccagctacttgggaggctgaggcaggacaatcgcttgaacccaggaggtagaggttgcagtgagccgagatgacaccactgcactccagcctgggtgacagaacaagactccatctcaaaaaaaagaaaaaaaaaagttaattgtcctaatactatttactgaaaatttactcttttgtgtttttttgttctgtctgtctgctcttgggctaataccacactatttaaactattctagtgaggcaaattttctcacatttttaatttttcctcaagtattattggctacttttgctttttttaatgtagagggtttttgtttttagagacagggttttactctgttgcctaggctgggatgcagtggtgtgatcataggtcactaaaccctcaaactcctgagcttcagagattgtcccatgtcagcctcccaagtagctgggactatagacaggtgccatcatgcccagctaattatttttttaattttagagatagagtcttgctaggttccccaggctggtctcgaactcctgacctcaaataatcctcccacctcaacctctgaagtagctgcaatgacaggtgcaagccactgtgtttggctagagtctcatgtttttctaattccaaaaaagttccataatgattttgattcagattgtattgagtttacacattaatttaagaagtgacatcttcataatactaactttccccaaaaagaaacagggtatgtttttccatttatatgagtggggttttttttgttttgtttttacgttttgtagttttcttcatataggttttgccagaggttcccaaactttcttggttcatggcatccttagtgtctcagtaattttttcatagcacccctgggctataagatatacttaatatttctgcttattaggtagttaaacaataagtatttgcgtcctaagaacttaataatcatttgaaaaaattatatacataaatcgaaaaaatttattcttaaataattacagtttcttactaatgagatatttgtgtctgcataacctctcaaaccttggaatcagcttggatatagccacccacatttcttgttcttcattgagttttcacagaaacttcaaaaatctagcttgcaaagacaggacattttcaaaaggaatgtagcaccattctaacgttaaactgtgaactactatgaactatctaaagctagtagttcacatagggtcacagataccacatataatagtgcttctctcaaaaatttaaaatatcttgtagtgcttctgggagttcatcatggtgccctgagacacaatatagttacggtgagattctgccaatttcttcatgcttatttctaaatattttgcattttttcttgctactctgaatgggattttcccctatgatattttttaactcttcatttctggaatctatgaatattgagtttgttacaggcaagtctggctgggtccttgaatatttatgactatatggaccttatacaaacaggcacacaaacacatatacaattaatgtagttaattaacccccttaagggacagtagcctcatttctgacataactttaggatagagtctagatacagaacaaaaggaagaactgggaaattattggatattaggagaggctaaaaatagaaaggcagcagaatctgggaagcagagatgcaaagtcacagaccaacagcaagggcaaagaaaaagaattgatggagggctggaaatgaagaagggagcaggaaaatatgggggcaggaggaagtattttaagagccactatggggtacttatttattatttcaatttataaaactgtgcccactgccaagccttctgggtacacgtggaacaataaataatatatgcccatctctacttccaactttgtatttttcctttcttttattagttgcattccccatctcccatttcccattatcagctatcactcctaatcccctgccaggaagacagatgagtgactcccactagatccacaggatgctttctggacaacttggtcagcatttcacttctacacacattccaccttcccctccagaggacatatccagggacccttgtgtatatacttgatatttatgaaggagtatgaatgggagttcagtattttgacctttgcttcatcctaccttagaagaggatttttgacttgagaaactaagctgagcattctcactaccgctctgtttggatattcttttcctacgtaaaattgtctaaaattgttgatatgatgccttttgctcattatagagatatacattgaccttgcttttaagaaacttgttctagaaaataagagagggcatctaaaatccgagggccatctataacatcaaaccttttccttgtttgctttagtttaactttcttgtcaacccttagaggtagatattattattcccattttgtagaagttattattatttctagagtcacactcctgtgtgtatcagagcaaggatttaaatctatctgcttggccgggcgcggtggctcacacctgtaatcccagcactttgggaggccgaggcgggtggatcacaaggtcaagagatcgagaccatcctggccaacatggtgaaaccccgtctctactaaaaaaaacaaaaattaggccgggcgcggtggctcacgcctgtaatcccagcactttgggaggctgaggtgggcggatcacgtgctcaggagatcgagaccatcctggctaacacggtgaaaccccgtccctactgaaaatacaaaaattagccgggcgtggtggcgggcgcctgtagtcccagctacttgggaggctgaggcaggagaatggcgtgaacccgggaggcagagcttgcagtgagccttgattgcaccacttcactccagcctgccaatagagcgagactccgcctcaaaaaaaaagaaaaaaggctatctgcttaattccagatttcgctctttctattaaaccatgttgcttccaggtaaaataggcaccaagctaagaaggaaagacatatgaatgaagagtataaaaggaagcacataaagccctggcattaaatataagctttcaatacacttttagccgccttttattggtgattattcttttaatggcttgttgttactgtgtttaacattcataatttgacatggccatatccaataggtacaagataacagatattattgggaaagaagagggaattggacccgagaaccttcgaggttctggaatgattgctggagaatcctcattggcctataatgagatcattaccatcagcctggtaaatctttccagaatgtgaaatttttgaagaactggctgtgtggctaggtttatttttttctcttatcactgctattcagtcccaaatgagagcatttcttgaagattgtatgtctataattatattttaatcacacatgataataggaagataggataatataaataactgaatttttcaaacaaacccagcactttgttttagcttttagtgtaacttctttttattttctttcttttttttttttgagatggagtctcgccctgtcaccaggctggagtgcagtggcacgatctcagctcactgcaacctccgcctcccgtgttcaagcaattttcctgcctcagcctcctgagtagctgggactacaggcgagtgccaccatgcccagctaattttcatatttttaatagagccggggtttcaccatgttggccaggatggtctcaatctcttgacctcgtgatccacccgcctcagcctccaaaagtgctgggattaccggcatgagctaccacacctggcccctctttccttttttttaagagacagagtcttactctatcacccaggctagagtacagtggtgcaatcatagctcactgcagcctttaccccctgggctcaagtgatcctcctacctcagcttccaggtagctaggactacaggcatgtgccaccacctccaactaatttttaacttttttgtagtgatgggggtctcactatgttgcccaagtaggtcttttttttttttgagacagagtctcactctgttgcccaggatggaatgcagtggcgtgatctcagctcactgcaacctctgcctcctgggttcaagtggttttcctgccttggcctcccgagtagctgggattacaggcacgtgccatgacgcccggataatttttgtatttttgctagagacagggtttcaccatgttggccaggctggtctcaaactcctgacctcaagtaattcaccagcctcagccttccaaagtgccgggattacaggtgtgagctgcctcgcccggccccaaggtagtcttgaactcctgggctcaagtgatccgcccacctcagactcccaaagtgctaggatgataggcatgagccattgcacccagcctgaattttgcatcattgtattttcttttctttgaccatgaaatttgtgtgtgtgtgttgttgtcaatcaaatagacttcataaaaagcaatgtttatttctgttaatttggattttacttatctatgccttagttcttatagcttcagagaggacataaatatgtgacatgtagaatttattcttttctaaggtgacgtgccgggccattgggattggggcttaccttgtccggctgggacagagaaccatccaggttgagaattctcacttaattctaacaggagctggagccctcaacaaagtaagtttctagggttttgaagaagtatgcatagctgattgaagattattgtgtgaattcttaattcaagatcctgattggaaggaagcagttcaatccgtgccttcctcagtctatctcttcccctctccctccatcttttctgcccattgacttgcttgcctttttattcattcattcattcattcatttcatttatcaactattttgagtacttactgttttctaggcactgttccaagccctgtgtatatgttagtgaacaaaccatataaaaccgctgctctaaagtgcttatgttttagtgtcgttgtagaaagacagaattaattgaacgcttctgttctgtcccacttctctctttttcttaatctattagtaaaagatgtgaggagatctatacacagacattgagctgtctctgattccagctgtgctggttcccatttcaggcctacatcatgaattaggtaccggcctaggtgttgagactatcaagttttaatgattttgtgaaatctgtaaatacacctctcgaaaagggcaccgatggtggtctcttgtatatagaagaaatatttggcaaatattgagtgggaagatgggtggatggatgcatggatgggttactgggaaagagtatgcataaagatttatcttcccttccaaagaaagatttgtgcctttttagtccaacttcacaagggtttttccaaaggggaaaaaaatggatggcaaggtcactgctcgaaagagtgaaaactatccaagaatacctgaatgtataaaggacagtgcagttctgacatctttgcaagcataggaaaattattttctcttcagggccagaaaagtataatggaatattctgaggctgactgcccttgtgcaacttatataacctctcagctcctcagctttcttatctgtcaaagggggataataatttaaacctttaaataatgtggagctcaaatgagaaaacataagtaaaagtacctagttctactgggcatgcctagattcccagctactcaggaggccgaaacaggaggatagcttgaacccagaagtttgaatccagcctgacaacatagtaagaccccatctcttaaaaaaaaaaagagtacctagttcttggcaaaaagtgttggcccacattcaaatttcagtttcccgttcctctctctaacatgatttggtgattgagcttatggagttaatacacatactaaattgtatcagatattatgtttactccacttgcaggaactttttatcaagtcttgactttcaagtttaagggtaagaattaagtgttctgtcattcccatttaggaaaaagttgataattccattggtttaattagattttgtggatgtcagaaattagaggaatcatttgatgcgatcagcttgctctgtgcattcatatgaactctgtatcctcctctgggcttgcttttctcatcaaggaaaggcacagcagtgctaacagtggcgaacttggctgtcttcctccctttttggagagtagcctggaaataaaggttgtgaaccactactactgaagattattattgcagtgggagaaactgctgagagtcttaaggttgttgttttttttttttttaagttgctcttttggataccttcttaggatgagatattgatgaatgccaaagataattttaggtaccattatctatgagaacagaatttttgaaagattttaaaaattctgttctcatagataatggtactttaaaaacctatatttccatgatgttcccatacccagtcagagagctaatttctgaaatatatcttcttatattgagtttctttctcccccctgccccgatactatattatatacaaagaatattacaaaaagcagatgttgggtttttggttttgttttgcttgaaaacttgctagttgaatttcatttgtgccatgaagaaacattagagattgatttcttaaaatctgattgaattgttctaatcaaattcattatattcactgtcatagcttacagggctgcttgttaaaacaaaagcttagttacagggtgaaagataaataaagctatagctttaacttaccaaacaatgctcacttccaaaagggcatatttgtttttagctgaagggagtgatcagatacagaggttacctaatgttgctctgcctgcttcactatcttcatgtcagctcctcttaagtatagagctgtgctgctgaagacacccgattttatgcaaattcgttcagaatatcctattagcccctttgcctataaggtatgaaaaaaggaaactaccatgctcagatggcttcctctgactcactccttctgtgtgttgtctttgtgtgtgctggtgtttttcttcatctctgtttgcctttctttctgtaggtatctctctgtattgtgtactttgggtgtgtgcaagtcaccctgagtgcatgtctctttctgtgtgggtgctgatctttctgtctctttgtgtctgtgtcttgcgtatagatccccctctttctctgtctgtgtgccgccctgtgtgttcatgtgtgagaaagtctttgtgtttttgaaacattatagagcctcctttcttaagccttggccattttgctcatagtatgtacctgtgtaaggtggaaatgtaggagacatgcaagcttatatacagtcttagactgtaaatatttgacccccacatttttgagtcttcatcctttatgttaaacattggggtgaagaataaggagtgggggtgttcagaggttgtaggggaaaaaaatcttgtgtgtgcaagtgccgatcctgttgacccctttgaaaattgaaataatgataatgcacgtctcctgactgcatcaaagtatcagcacatcaaaagccaggaggcatgaaatgcaaatgataaagtgaaagcagatggattgtgcatgatcgcctgatgcccaatgaattttaaaaggtgctggtttgcaggaaggggggttggggggttttgggggggactgaaataaacacgttatccctgcaatttttttttgttcttgatgctcactcctgacaatattttttcacacttgagtgaacaccctctctctctctctcccccctccttcttctctccctttctctctcctctccaaatcccctcctctgccccccccttcccccccacctcttacacatctcaggtcatgtcgctgcagctccggtggaaataataagatataaaccacgaggttgttatttgcatagaaatagcatggagccccaggcagcaagggagaaggacacagggatgatttgtctaaaattttaatgaaaacttttgctgaggcagagatttttaaaaactttctttctccctgcttttccccttccttcccctaccccccaaaccccatcattgattttacttaacatggttcagtttgaagagaaaaggttgacactccacatatcatactcccataatgcagcaacctgtaaattgtttcttcctttaatagatatgaagctgaagagacatgcattttcaacttaatacattgcatgtgtgcgcctggcttttatggctatactccatcttggcatacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtttttctgtatacttacatgttttattcatggacgccatcctttgtcactgtgtcttttattccaaaaccaggaagtgcttcccaccttcgtatttttatccttttccccctgtgaactcaccatttgtgtatcttctttccatgtctgtcttgctttgttgcctgcagttatttgtaaaatattcaaaatattacccaaattgagatgagttgtagtatctggattttattgagtgttactaagcacatttgacattagaactaaaggcagtaggctggtgattagaagcagcccaagtgggtttgcttgaaattcagtcaagaatatctgtctggttccttgctatcttctggaatgggctaatggtatcagggctatatttcgtagacaggaaggcaaaaacagaagggaaagtgacttagtttcattgagagagactagatcagggtcagaacatgaactttcatgtccctaagtttcactgaagaaagctcaggcctctttgcttagtggtctgtaaagcctaagagaaggtggtccggtcgttttcctgtttgtccaaatgtcgtgagaatgatgacattaataagagaagtttctaggggcttgctatttcatgtcactcaaggtagtagatcctaactctaggaactgtaggctgtgggtgacagattccttaaaatgcctcactgcgtggcagacctgatgtgtgtggcaaattaccctgcttgaagggagtcatgctggcctggcaaaggcagtaacctgtgtacttggggaactgttaagatgcacccttaaggagctgagatgattgcagagtcataaactcttaagtctatttgccactggacatttgcagagatgatcatatttacttccctcctcccaccactcttcctctcagtttcctttttactttatttttttctccctttcctggtaaaagtattagtatgtttaacatagtgttaggtggcagataggctgggaagagctagtattgtaaaggaacactgatgtgtactggagcctactagctctcaatccattgccccagacttggggagagagagcacattctctatccagagaaataagaatatgcagtttatggttgtcctgtggacattaactgactgtgaaggtaaggtatatgccaaaggcagtgatatgcaggtgatagattcaccgggagatgatatgtgacttttcttgtattttaaagctctgcttcttttttagaaaaaaaaaaatcctatactctcatcccccttagcgagatcaggcccctatttccactgaatctgccaggaaaaaagaagttatgtgatgggtatgactagggccattagtttggtagggggctaattctgctaatcttgcttttgagacttggtgcaagtaagttacatttctctctggttctcatatatgtatttttctgcagctatgcagtatgaaatgtgaagttgtcatagctgactctgttaggcacagtaccagagttcctctcaggagtgggaattgtctgttacaccagggacctgcactgtgtagtctccatgctcacccacccatgactctgtgaaacacagcatgaaagtcatggaggctcaagaagggaaggagagattacttagctctcactgtggggcgggcagcattgtaactttcacataacttaaagaggttacgatagagacagcgccggggcaagcgagagccagacaggcactgggtgactctgtgcctcgctgtggaaaaacaactaaacatgggcaaaggagatcctaagaagcctagaggcaagatgttgtcatacgcattttttgtgcaaacttgttgggaggagcataagaagcatccagatgcttcagtcaacttctcagttttctaagaagtgctcagagaggtggaagaccatgtctgctaaacagaagggaaaatttgaagatatggcaaagacagacaagacccattatgaaagagaaatgaaaacctacgtccctcctgaaggggagacaaaaaagaagttcagggatcccaatgcacccaagaggcttccttcagcgttcttcctgttgtattctgagtatcgcccaaaaatcaaaggagaacatcctggcttgtccattggtgatgttgcaaagaaactgggagagatgtggaataacactgctgcagatgacaagcagccttatgaaaagaaggctgcgaagctgaaggaaaaatacgaaaaggatactgctgcatattgagctaaaggaaagcctgatgcagcaaaaaagggagttgccaaggccgaaaaagcaagaaaaacaaggaagatgaggaagatgaagaggatgaggaggaggaagatgaagaagatgatgatgatgaataagttggttctagcacagatttttttcttgtctataaagcatttaacccccctgtatacaactcactccttttaaagaaaaaaattgaaatgtaaggctgtgtaagaatttttttaaactgtatggtgtcttcttttgtatagttaacacactaccaaaagtgtctttagatagccctgtcctggtggtattttcatagccactaaccttgcctggtacaggatgggggttgtaaattggcataaaaattttaagcaggttcttattggtgcacagcacatgtaagttatatatggggttggtagttttttcattttcaattgtctctgatgcagcttatatgaaacaattgttctgttaactgaataccactctgtaattgcaaaaaaaaaaaaaaagttgcagctgttttgttggcattctgaatgcttctaagtaaattacaatttttttattagttaaaaaaaaaaaaaagatgttatgagcatggagaggctagagccaggctgcccaggtttaattcttggctctaccacctacttagttgtgtgacctcgggcaatttatttaacctctctgggctacagttttattaactgtaaaagatgagtaataatagtatctgtgtaccagagtcgctgtgagaattaaatgagccaaaataggtaaaacattggcactgccatagtcttctctaaggttcatttagggttccttctcattgcaatttcttatcctggttctggaaaggaaatacgaacacattattctctatactttctgattctttgaaggcaaaaatttcttccagaaaatgttagatgacagtcctcactgtggcagtacattcatgtattgactttcccaatagatgtatctagcaacaatcaacgcactttggaaagccattaatgtgagaggcacgatgttcagtcgtgacagggtagtatatatgtcagtcatctgtctacaagagtccccaaggactcgttgatacaatagctcataatcactctaaggatcagtctagcaatttgcatttttaaaagtccctaactacctattttcacaatagacagtccctgtactcccatagctccagatgggatcactctcctttctaaagagggcattttagcttcctttctgagtaatccttgctttagcattatgaatgaattctcagaaattattgcacaatggacagatctccctaattttcaagcgctccctccccacacataaaatattggtaaatctggccccatttggggggattattttgtttgtttttcattcaatattcctcaagtttggtagaaaactataccaggttatgttttgactctattagtctgccttagtgacctgccaacaatcctgagtgctctggtttggagatcttgcagggtggaatcgccacacagagctccactgcagaagttgtctctgactctaagagagcccatgcatatatggtggcttagagtctaagaatttgggagaccctacagcaagtaccagtccagagcttctagataaagtgaaagctctgagactctatttggggcattgaatacagactcggaaattatcatgtttgacaacctattatgaatgtgctcaaattttttggagttacagaacctttagattaaaaaaaaaaaaacaaaaaaaacaaaaaaaacttggccaggcatggtggctcatgcctgtaatcccagcactttgggaggcagaggcaggcggatcacctgaggtcagtggtttgagaccagcctggccaacatggtaaagccctgtctctactaaaaatacaaaattagccaggcgtggtggcacacacctgtaatcccagctactcaggaggctgaggcaggagaatcacttgaacctgggaggcagaggtggcagcgagccaagattgcaccattgcactccagcctgggcaaaaacagcaaaactccatctcagaaaaaaaaaaacaaaaaacttttgattgttcttctccctgacatttactaggtaagcaactttgggctttaatctatttagatgttagtttcctctttgtgaaatggaaggcataatacatttcccattttaaagtagaaaatcaggttggcgtggtaatcctataatccaagcactttgggaggccaaggaaggaggatggcttgaggccaggagttcaagaccaggctggccaatatagcaagaagcaagaccccctctacaaaataattaaaaaattagccaggtgtgggggtgcctgagatggggaaccgtggaacctttggcagtggcatccagggctgggaccatggccgtgaacagggcctgggccccacagagctcatggaggcaaggctgagggcaaggaatggatgaccaagttgggccacctggtcaaggacatgaagatcaagtccctggaggagatctatctcttctccctgcccatcaaggaatctgagatcactaactttttcgtggggacctctctcaaggatgaggttttgaagattatgccagtgcagaagcagacgcgtgcttgccagcacatcaggttcaagatgtttgttgccatcagggactacaatggccatgttggtctgggtgttaagtacttcagggaggtggccactgccatccatggggccatcatcctggccaagctcttcattgtccccatgcacagaggctactgggagaagaaggcccacaccattccttgcaaggtgacaggtggctgtggctctgtgctggtgcgcctcatccctgcacccggggcactggcatcatctcggccctggtgcccaagaagctgctgatgatggccagtattgatgactgctacacctcagccaggggctgcactgccaccctagggaactttctcaaggccatctttgatgccatctctaaaacctacagctacctgacccccgacctctggaaggagactgtattcatcaagtcttcctgtcaggaattcactgaccacctcatcaagacccacaccagagtctccatgcaggggacccaggctccaactgtggctacaacacagagtttttacataagaaaaataaagtgaattaagcctgtttttggtttgcttgttttttttaagtagaagaccagaggatctcttaatcttaaattctgttcaatatctagtattctgtgatgctataaagatgcatattgatctgtagccagggaactgttttaggctggggagtgaatagataggaggtggggaatttttaaagttattgcgtattagggtattatatataaaattacatattagtgatatataaaattattacatactcgtgagaccaggaatggaagttgaagagcatgatgatttaaaattttttttaattttgtttcttatccagattacagaaaagtaaacactatatgttgttcacaatcacaagtggctgtagaattataaatcttgagagtgggaggatcctcaaaagttcaaccacacaattgttgtgtgaatctcctctgtgacaccattgctaaatattcacccaattatgtgtgaaaaattcaactgaatgggagctgagtacttttggagccaatcccattcatctatgtattcatctgtgaattcttttttatatttggctaaagtctgtttccctgtacagagactgatcactctttaaagacagtgttcaaatttaacaaagaaactcccagttttgtgatatgaccaattggaaattgaatggaaccaaaatctttctcatgtacttttgtgttcagagtctggtcttgtctcaagaacaaatgtagtgaagatgaaaatgctattccaagatagaaaagaaattggattcataaataactttgccagttaaaaatgtgaaataagtagaagaaacaagagaaacagttaaaacttaattccacttggaagtactccttggaaccttaggggtctcctgcagtgccatgcagtaccttcggagcccgattatctcctgctttctcctcctctgccttgttgaaagtccagatcctgaaataaggttggaggatatttctttttgactgctatatttgtagataccagctaaaactcattgggcctaagatttggtggaatcagtaaaggtgatgtagacttaggtactcaaaccccaagggtacacaaacacaagctaaactgctagaatgtattaccctcttgcctcagtgaacagtctctggctcacttcatccatgtggaccttcattatatctctaccctatatccattgtccatttccacctccagggttctgatgtgtcctgagtattagaatgaagaaatgcctctacctcacactttgggtggcatgtagggtctctacactgtctgtttctaataaaacattgtctctgaactcaagctaagggcccacttagctctgtacacacggttccttaggaagattggtttcttcgtcttcttcattttatattcagttgtgtgttacaccttcatatgttgaattttcttcacctgtctctctttctacatatattcatagctctgtctttgcagatcagtgctcacttgaagctttgctactctgtcaacccctctcctctcttcagcctttcttctcccccaaccccagcctgaagcccaagtaaattagcttatcacccctgccccctagttgtaaaaaaattcccgtactcctccaacagtgtctattcttggatttgcagtcagcaaccatctccaataaccatcaggctgtcagctttgcagctccctaccacctcccacctcccccattactcaccagaagaaaaagagagccagagcaagagcttgaaatatatcatgcaatagtgtatcatgaatttgttgtgaatcacagtggtgaagcaggtttatttatttctgagaccttaaatcaatacaaagtaggtctcttagttctgaagctgggatggagtgtgaaaaaatgagcccattgtactcttacaactttggggaaaggagatgacagctatataattccatttaccaggcactaggggctttaatgtgaaggtgacagggagctctttgtgcatttagagcaccatatcttctaaataaaagatctgtagacttgatagtggagcatagctccaagtttaataatctccaagcattagaccgagccaatatgttcccaagtcagaaaggtcccccttaacactcataaattaaaagtgcaagaaccacacgttagtagattagaaatgcaaggactccagtcttttctagaaggaagacagagctgggccctggctgtgcacagactggtctatgaatatgataaagaagcggaaatgagactgtttagaaacctgactcctagctgttcatcattctagggaatgttccctgtgcatggatccaaatctagctatgtcccttctcattcagattggccatcatcacacagtctaatcagctaatgtacacagtcaggaatattgaattatgaaaggagaagcttaaagagctttttagattgaactacagattaccatgcctgggcttcaagattttctggctgatttttgaccggttcctaattttaataatgtctcagtgtctgggatttaagccttctaaaatagtatgcgcgtctaagaaattgagaaatcagtgttggtaaggaaaagaacccacccaaatttaaccaacagcataagatgcaaatatgagaagtcaagaccattggaacatgtaatcaacttttgagtaacttcattttctacctgacccattggtaaaatatgcctttctcaatagataaagcaggtttatgcagctcagaagagcattcctaacataatatgactttatagtacttagaattactagtttaattttagcccatgtaaagaattttgacagggagggagggagaggggcatctacattggggaaaactaaaaaggtaggaaaattgaaccactccttttgcttcagaaagccactacacattataacactaatatgaaagacttattttgcttatagtggtttaacttgctgaacatactaatcagttgaggttttatagaatacatagaaatgtggtagatcacatgcatttattgcatgcctgttaggtataaagctgttcttatgctgtggcaatacaaagatgattcctgctttcatggagctgaaatttagctaaaagacaataataggcctttcatgtgttctaaaggaaaaaataaaattgctgcccatcagacgtcaatgagaaaacacaaaccaaaaggccacagagatagtaagtcagtgctactcccctaagagcgaggccctgcaaacaccatactcttggggcctggacactggtgagcaatgcagtcagtcacagcctattcagtaaaaccagtaggaggcgactgacaaacagggatttttttaaaagttttccatctttagaaaatacataatctgataaaagattggtatccaaaagaattctcaaactcagtaagaaaacaacccagtaattaaaaacatgggcaagaaatttgaacagacattacaccaaagaaaatataaggatggtaaataagcacatgaaaagatgcttatcattagtcattagggaaatgaagattaaaccacagcttgacaccactaaatggtgttttttgttttgttttttgttttttgctttttttttttttgagacggagtctcgctctgtcgctcaggctggagtacagtggtgcaatcttggctcactgcaacctccacctcccgggttcaagcgattctcctgcctcagcctcccaagtagctagggactacaggcatgtgccaccacgccccggctaatttttatatttttagtagagatgaggtttcaccgtgttatccaggatggtctcaatctccttacctcatgatctgcctgcctaggcctcccaaagtgctgggattacaggtgtgagccactgtgcctggcctaaatggtttttttttaatgtttgacaaataccaagtgttgatgaggatgcaggacagctggaactctcatagattgttggtgggaatgcaaaatggcacagccactttgaaaaaggttgggcttttcttaaaacctgtacacaaatgtctatagcagtgttatttataatcctccaaaagtgaaaacaacccaaatgtacaccaacaggcaaacgggttaccaagttgtggtacttccataaaatggaatattactcaggaataaaaataaactactgatacctgcatcagcatgaatgaggcttagatgcaatatgctaactgaaagaagctagattcaaaaggctatgtactgtatgactccatttatgtaacattctagaaaaggcaaaactactggaacaaaaagatcaatggttgttaggggtggagggagggaagggaacatgaggagactttgggatgatgaaaatgctctctatcttgattgttgtggtggttatatgactatgtgtattaaaattcacagacttgtataccttatgatggacagttttgctgtatgtaaattatacttcaataaaccagactttatttaaaatttttaaaaattggctgggcatggtggctcatgtctgtaatcccagcactttgggaaactgaggcgagaggattgcttgaggccaggtcttcgataccagcctagacaacgtgcaagaccttgtctctacaaaaaaaaaaaaaaaagaattcctgtttggaattaacttatcagaaatctcaagtccctacctacatgagcagttggtgggtccccctagggtgagtgattacttttggcagctttctttccagaagcctgtgcttcttctcatacatttagcaaactattgtgtggctcctctctatcttttacattacaaatgagtctctgttccttacccactccaccttcaaatccttattgtctttctgctgtctaattcattcctctgttctccactgagccctgtacctcagtaaagagatgtcttccagtgttatttctggcctatattcagcctctttttggctgtttcttttccttccactgacagtaccacccctttgccccagtttatccttcagcatacctgatcacttcatgatttgctgcttatagagagatttttggtcttatagcaaatggtcttgaatccagctgtggctcatgtcagaggcttttctctcttctgcccacagtatgtcaccgagccccttctctaccccaaccctagcctagcacctgccagccagcactccagtttgccagtgacagtagtggcaataaagtggggaaaaaattataaccctttgcctatgcattaagaaactgtattttggaacccccaaataatcttgttggtcacataggtcctggttccatctccctagagatttaattccattcacccttggatatattcctgaagaaacattgacacagtgatatgtgcagcaccacttaaaattgttaattggagattgaattacttgtcagatttttaaaatgtagtcctctcaggtcagggaggaggatattagctgcactgagtagatgagctattgcatttttttcttctccttcctcctttctctccccctcccttttcctctctctcatccttccttctttcttttgtccctattttaccacttttcctctactcctgcttattctttctcatatctgttctctttcagctttagccaacctttatcaataacctgacagatcccagagtgactttaatatctagaatcatggatgaagtccagtgatgacaattactcagtaaatttacaaaacccctcctcaaatcctcttgagaatggaaatgtcctaataagaaggaggattgcagcgaggactcagcttgtgtagcctaattcttagatgcaggaggaattttgtattccctgcttccttaaatagatgtcctgacccaccgagcattgtttaaagagggggaaaagactgaataaagaggaggagaaggaatagatttcattttttattccatcattgatatgcatgataatttttcacatcttcagcacatgattgcaaatatttgcctataagtctaagggtccccaacataatgtgtatgtcaggacaaaggcaatttttaaaaaattgagctaagttgcatctgtgaaacttggaaatctcaatgcctgtgctgacaaatatcctgacaagtaaatactgcactcattcagtattacatagtgatttcatttgcacaaaacatcacaatgctctgccacttcagtcaaacgtctggagcatgggggaaaggaagtacgtgtttatcttgatctccaaaaagggctttaagggagagagcaggcggtatattaggctgttttcattgcctgtcagctgtggtaaacctgagctgtctgcagtgtctctagataagcagcagcagcagcagaggcctgagcatggacgtatgactgcattcatttgtacttcttatgtatctcaacatttctaaaggctacgtagcatctttggtggagcctttaacaattgtgtctctgctaatcaccggcttttatgtggtgcccttaattcttaggtccgccggctgcaatgaatgaagtactggatgaggcttaagtttatattgagaatgagtcaagatcctctttcctctcagattcagcccttattcaattctgtcagcatggcactcttcagcagaggaccccaaggtggagcccattcctaatattgcatggtactgcttctccacttagatctggagggcaagaaagtgaggcctcaggagaatcacctctgtttgactcactcctgtgtttaaatgattattgatgcttgctggacagataaattaaaagtttgtatcatacagtaagtagaatgtaagaggaatatatttgggaactgaaacacggcaagaaatgcgtaggtcaaagtttaaaagagtgttgaatgcagctcacctacttcatgaaaatatgttgatgagagttgttgaccccaggtttttctgtagaaggtcagcagggcaaccttgaggaagaaaacaatggttctgtctatgtggactccattcgtcttcctagatactgatgagggtttgtgtaactgttatagcatgatcatttcacagttaggcagaatggattttatcctaacccagattctgcttccttggttggagcttttgttgtgaagtattctaaaatcattaaaaccacttgagtcagcaacgacccctataaatcaggagctattgtgtgcgccctcattctactggcgcatactccaaacatgtggtcattgaagatgaactggagggtactgctttctcttcaccgattgttaagtagttatgattgttagcatttgtttgtgattagtggagcagtttcatttctgtgcccatccccaccctaccccccatctcccaagataaggctggtcagagagtgatattgggatactcttagtctattctgtaatttttctccttaatttctgaattaagtgaattttctcacatgacaaacacttctttagctcagaaataatgttcttggtatgttaagccctggttaggtttcttctaaacataggaaaggagagatgtagaaatactgctgccttttcagaacaatgccaaagcatcagaacccgagttttagcttgtaaagagaagagtactcagttattgagcctaccaagtttgcctcccattattttgtaaaaatatggggtagaatagataagtggcagaggatcacttttaaatgaggaggcaaagacatcagaagaaagtatgtttaaacagctgagcggtccctttttctgagtgtagttctttattggtccattattagttttggagatgtgtaagattctaagtggttggacattatcaggtattagagataggaagaaaatagtgtttctgagtagaaaatggcccagctctctcttctgggcaacaaggagtacttggctcctgacctagattgtgaatatcagattttcagggtcagcacagtgtctccttttgtattccttttccccctttccaattttattttaataattaaaaatactgctgatcacactgaatgccttctaacagagaggcagtctgtcccagaaggaccagttgtgggccatcgggtttatgacgaccataaaaccagagccagatcagagcgtggcctctgtaagtgacagggtttctgcctctaccaggctcccgcatcaacagactgctttggatatttgctttggtttggattttttgttctgttttgtttcctgatgcatgtgtgagtgtgcatgtgtgtgcacatttaaagatataaatgaaacaggtatgtaatgccctctgcctgttagaaagactaaagccataaaaataacaaacggcgtgtatttgctagaatgtcaaagttatgagtttattttgtaatgatgtgctcctgccttcatgaggtaaactggccgtggcggaggtgttattagtaatatggactcagcagagcagaaagctgagtgaccgagagatcagtgtatcagtcagagagagggcaaatggaaagagacagcaggagaatgagaaaagagccgcagtgcctgggctgagattaaagacggactgagaggcggatgggagctcagtggtcagataccgtcttccctcttcacgaggctccttcaaaggagctgccagcatgttgctcagcttggggctgcctgtaaaggcttgttctctgcgcttccttatcaaggaaaacagtaatctgagagcaattttgctttccatattcctttcagaaaagtatcttatgcccttcctagctgaagttaaatggaatcaaggccaattgggtcacactgaggttattactttggtcaccaacttcctccatctttggaaggtcccgatgggggtgctgacccagcatgcaggggaacctctcaaagctcctaacaagaaggggcaaaatgggaatatacaggcagactttgctggcccttagttagttagattctccccagagactgaaaatgaatacacgtacggaagaaattttgtattgtcgttattttttaaaggaggaggggaaaggaaaaagaaaaggtaaaatacagtaagcgctctacaactgtttagagctctccggggctaccttagatgactgacaattactatacactcagcagtttgcaatagtcagtgatcaggctgcccggcttccatctgctgggtcagaaaacctccttccctgaaagaaattattaaccagtcttcaagggaaaaagaaaccctgcaatttccaagtccaggaatatcttttcttcctctttttttcttctttaaaggaaactttgtggtttccaattgcaggtgccctttgaccttacaaggattaaattcctccagggatataccagggattgaggccctgaactccctggagcctgggaagggaaggaggaggggaagcatgcttgggtataaatcacagccctgcacccagcacacaaagaagacttgagactcaggggttcatgtatgtatcatgagttgcttcaggtttttgctagctttagggcttgtgcgtggaggccagtgttaggctggtgcaaaagtaattgtggttttgccattaaatgacaaaaaccacaattacttttgcaccaatctaataaaaatcaaatataaggaaaaaaataatcctttttaaaaatgaggaacctaagcccccagagtttctttaactgagacttgtcactaaatattgttgaaagacaggcatgttacctttttgtgtctgtgtgcaaagagacttgcacacaatgaggtagcctatgcctctgggtctcagcctcacccaccactgcagtttcagctgagggtggaagtatgctttgcctatctgtggcagctggtggagagaaaggggcttgctggttttaaaattgcaaccatgaatgtgattgttaaaagtattttttgtttttttttaattttttattttatttttattatacttcaagttttagggtacatgtgcacaacgtgcaggtttgttacatatgtatacatgtgccgcgttggtgtgctgcacccattaactcgtcatttagcattaggtatatctcctaatgctatagtaagccctcttagcgcagctggcagcgcgtcaatctcatattttttgttttctaagttttctttttaggaagaagattcagatagtccctcagaacaaccaacccatggagactgaaatctctgttttgtggagaaaagaacccattttagtgcgacttgtgaaatcgaccatgcctttatttctatagagacaaatgtcttttctcttgctcttttctctaggtcctcgggcgggaagtgtacacctccaataaccagctggggggcatccagattatgcacaacaatggggtgacccactgcactgtgtgtgatgactttgaaggggttttcactgtcctgcactggctgtcttacatgcccaaggtgagcccttcctacccagcactgacatggcctgcagagcctgtcatttccaccacagctcactgcctctgtgtttaaggtcttgtctttatggtggaggaatttttttataaaatatttctctgaaagctattgatttctcttttccttacagccatattttgccttctacctttaagatgtctctggatttcatttgttgggcccctttctaatgtcttccagccacggaagccctcatggcctacctaaggctcagatcccagtatattaaggttcctcctcattgtgggttttctcctctgtaatagccattcattcctcagaggagcatcccagaaagcatgggcacactgaaatcaagagtcaaaacacaccactttgtgccagcctcctaaatgagactattgacctatacatgttccttggggcctggcacatacgtaggattcttccagctgaagattgggactattgggtgcaattccatacgtgggccctgctgtctttgtctgtaactattgttgctgagttggagtctagggctgtcgttcactgattgctgtgctctcttccaatctccttttagagcgtgcacagttcagttcctcttctgaactcaaaggatcctatagacagaatcatcgagtttgttcccacaaagaccccatacgatcctcgatggatgctagcaggccgtcctcacccaagtatgtatatgtttgaggaccccatggtacctggctcttaagcttttagcgttcttttcaatcactatccaattcctgaacaatcacatgtgactaagaaaacagaggtaagtacctagaaatgagaaagacctgaaaaccagccctctgaagaaaaaggtgggaaatccttcatgaaaaaatgaaaaataaataaaatgacatttcccaatcacccattaagtcaagcagtgcagtcacgaatacatttcttctgtttattctgttattaaagcacttattacttaatgggttcaaagactttaacacagttcaatataagccataaaatcataaaattataggactagaatcttcagtcatctaatccctacaaccaaaagagattaatcagtttcgttttagcacacgtctttgagacccttcagtgtagaatatgacttcactcttctcagcaagctctgagcacccacgctgcatgtgcccttcttatgatattggtaatggtattggtacttgctttagtaagtaatagaaggctactttgtaagttcatttattcatgaagagattgtccagaacttttaattatatagatacatggagtgagaataagctctccctccagatatatctaatctactgctttgtcttttacctaacttagaaacaaaacaggaaaaagaagtaactctgtgtacattctcatttgtcagtccatttggctgttctagcaaaccttacttatcaggaggttcttttgtggagcaccaaatccctctgctgtattttgaatccattttttcaaactatgtgaggaagcatttgttcttttttgcatatttattgcaactatttcaaagaaaggctatatataaaagtagaagagattgcagaaggtattttattaagtgtaaaagtcattgtgatcttgctgaaagagaggtcttcataaggaagacctaataaacttttgtgggtacccactgtaagccaggtgggactgtaaagcacttccacatcttttttgcacttacgacctctcttagataaagagagataactattttacaaaaatcagagaagttgagtgattcgtacaaggtcacatagctattatatagctattacattgtttttctacaatatttacattagactttctattatataaaaacatgagagaagtgtttattttaatttataactttacctgttgtcttcagtgcctcttcttgttaattttaataaaacgaaatagtttttctttacatgcctggaaagtcaccatactaatcttcttcctactgttttttttttttttttttttttttttttttttttttagatggagtttcactcttgtcctccaggctggagtacaatggcatgatctcggctcactgcaacctccgcctccacttaccccttctttccccttttttttgtgccatgattatgataagaactatgagcctaagattacctgtcagtctttttttttttctttttcttttttttttttttgaggcggagtctcactctgtcgccaggctggagtgcagtggcgcgatctcggctcactgcaacctccgcctcccaggttcaagtggttctcctgcttcagcctcctaagcagctgggactaaaggtgcatgccaccacacccagctaatttttgtaattttagtagagacggggtttcaccatgttggccaggatggtctttatctcttgaccttgtgatctcaaagtgctgggattataggcgtgagccaccgcgcccggccacctgtcagtcttaaaatgcaggacttttctgggaatgaagtgagcctctttacttctagaatttggaacaagacttagtgagttttttcctgggaaatacgggaagccatcttagccggcttctaaggttctgcatcggaactgggtaggatctactctctggggactgtgaagcacaactacaatagtcagtgactcctcctacccctagcaggagagtttttaaagaagaaaacatttccatcttgaagttaattctgtagttccaaatccctgttattgaagtaagaattagaaaatgatccaaagatataaagttaaaattcagtgttctgatgaacctagaaatttggtttagaaacttcaccaaaatttgagtccttctttcatgggtgaacagaagtatgtgtgtgtaggtgggcattatcctggccattattaatgaaatccacagaataaaatgaaatttttgataaactaagttttctgttttttggataatattttttcattgactccctagtaattcatcctgctgtctatgtgcagctaacactcgctcccaaatcgagtgacttcagattttaatttagtggaagcgttaaagaaagcagatgattccctgtgataagttaaagcagatatcttctaggtgaaaagttaaagtcatttattagaggagatagtgctgtgatattcttcaaactgacgcccaacacaagaccagaatctaaacgatcggctttgggctcacggatggagagataattttgaaatggatgatcacattttacactggggccatagaggcaaggaatgtagaacacagtaattacaagtttagtctagataaaacactctccatcctgtttaagtcagcagaggttagcttgctcagatctccacttttaattggttttggacttgggtttttagggggtggagggccatgttcaaattagaagaatcactgaaaaccgtgagctgagagggcaaactaggaaacggttatttgcagaagcttttatggggctttggtcaaacatttatacctgtggaacaaaagttttttttttaaactaacatgttgaaaattttgggtcttgccagtgaaggaaattctatgtgcaaggaagattaatggcattaagtatgtgcatcttaaccattgtatttttactatctgtcaagaatatgtggcccttttttgtagaaaggttatactttatcagctgtttaataaagtagatatatcttgttgcttttgtagcggagaaactgagttcctatttttccctccaaatttggatccttatctgatcattaatacttattgtttggttgtttttagccttcagttaaaagaaagtcagtggaatcaaacaaaattgtaaggcaagttttaaaatagaaatagacattttgaaaatatctttaatgacttggcagccttttgacaaatgtttgtagtgtcttgaagaaagtcaagttatttatttaaaagcatgcaaactctctctgctagctaaaccttgtcatttaacaataaatgatgcttttgctgataaatgattctttttatgcagactagcaaatgaaataggagatgatgtctgaaggcagatgaacattcagctgcctaatgcttccatctattataatttggttaaaaacaacaaactccccaaaataatcccccaaaccaccttaaattcgtcagttccagcacattgtcaatggattcactgtccttattctctgttttctttctttcccttctgtagcccaaaaaggtcagtggttgagtggcttttttgactatggatctttctcagagattatgcagccctgggcacagactgtggtggttggtagagccaggtaagagctcttttgttttggcagctctttttcctcccaactaaaaataagaaagaaagagccatggctctatagatatataccaataatgttctctttgtctgaactgtctgagaatattggattatagccatgcccaaggcaaaataattggagtgctggttctcagttgccattttgtgtgtcactccaatgatgcgtttaatctgaaggctaattttgacaacacttcctttttataatgtttcaggaaaaacactttgggagctgtaaagcccaactacaatagccagagcccaccaatgactttccctctcccaaagacaattttctttcaggaataggtgacaagtgattcagagactcatctgcttttctatgtaactggaaagaggttcttcgtggcaccgagattatttaagtgacaaatgtactatattggattataatcagatgtgaattgccaaaaaaaaaagtttacctgaaacaggagtaaaataagctgaaataggttgccaagatacctatatttttgaagtgggaaattgaagtttctattaaattttaatacctactctaagaagtgcttcactcaacagcaagctctgtgcaaaataatctgtagtgcttgctataacgagctataacgagcacctgccacgactgatcttaatctacttctgcactgcagagacatgctgctgagggaccgcatctggagctcaccttcctctgggggcaatcagttttccttatcttggtgaaaagtggcacctgctcaagattctcaaacatgccacattgggttgagatttagattctagccttgaaaataattctaggctctgtggttctctcagtacagcaggtcagcacgcctccatgctgcctgtgacaagaagccatcagagggcaaatcccacagacagggtcttcctctgtgactctgaataggattctggcctggagtcagctcagactgaatgtcccagagcctacctgtctgttttctttaaagtctcaggtcttttatctcaccccaggcttctcagtcccagtgagaagtattctctgtgcctggtaaaattcccagtggggagcttggaagtaggagatacactggagcgagaaccctgatactcgactcctgtatcagcttgttagattcctcacggcacactaagaccaacttttttgagatttgtctcatctattctgcttcaattttcctgtctgtgaaaaaacatgacagattttaagtctcagaaagccaaacctttgttaagttctttaagatcctcccatgggaaataagagaaaaatactttacacttatgattagaagaatagggattgctttgcgaccaagatcagtcaagcttggctttggttagctctgtcattgtttattgcaacactcactctgacttcctcctttctttctatctgacgagttctgggcttcttactccaaacgtatacacatactcacaagtatataaaacacaaatggagctctagcttctttcaaaagcaatggcatttcaagaaataaatataaatgtattcgtctgggattgttactgtaagtgctgccaaaactcatctttggtatgtatgtttggaatatgtgtgctattggctgtaaattgtcttttattattccatggcaccttgtccagggacacactataaaacaagatgtagcatcttcatgtgctagcctgataaaatttatatgaagtataatagaaaacagaagttgttctgagctgttttcaagttcaataaataactgtaatacttggataaagatgttctttattaggtcacatgggccctaatatataagttataagttaccgatttagggtggcttttgcaattacaagtttccagttggattgttaatcattgtgaacagaaatatttctaaaccctcctgtgtatctcctgctcgttgtctggttgtctagagggcttttgattctgattcagtgcaggcaagtgacaagggggtgggtggtctccactcaggcccttgtcagccctcttgtgatgacaggaatccattttcactagccaatttaacaaccaaaggccatctgtcatggaaaagtttgttatggagatgctgtgagaaatgagagactataacccatcccagccccaaccccaaggaatgcaacagtgagaatgaagactgcatcacattttccagagtaaagactcaccctgtactttgtcttgctctctgatttttcctagaaaatctttatgaggaccaaattgggaagtcatagtggagtataaggtgcagaggctttgagctcctaaacagttttttaaataaacatagctttgagattaaatatataattctaatatagacttcaccagcattactactaaaaattatccttgtcccatttgtcttttccaaggaaggagaaaattaagggcttgttgatccacttccctattcttggcatgtgtttctcatcatcctcataacatgcctacatactccctatccacacacctaatagtaagacctattgtaccctcaaatcttatctggaaccacattattaatattccatagaaaactacagctccatttcagcaaggtcagtcctcattaaaagttactgaaagtctcagattcctactgcctttcagaccatttcctaccatcttcaccaaggagatgctctagagtgaactgagaaatttcgtttagcagccacaggggtagggatgtgtatatgtgctaggctgttgagtctaaatgtagaggctcccctagaacagcccttggtttgaatttatcttgtgttgggacatttccgaatagaagtgattctgagggtggtttcccaccatatttagagagtaaatatcaaatccgtagagtctcacatttaactcatagaagaatcagatttcccctgctctctgtgtttgtttctagttttttccccaatgtcttgatttgggattggaaaacaaatggctagctataatgttgacatacattgggttcttatgtgactcatgttttatcaggctaggaggaatacctgtgggagttgttgctgtagaaacccgaacagtagaactaagtatcccagctgatccagcaaacctggattctgaagccaaggtaggccacctcaagtacactgggggctgtgcttggagggtttttctcttcgcagtgcctgtgaatacatcaggaacattgcaaaccatcagttttagagggaagggcatcagcagccttgaatgattttagaacatcatgtgctcacttttaaggtgagtctaaacggactagaagctaaattctgcctcaaaaattaaataagtctttacagtagtcttcttgatgctagaaaacgtatacttttgttggggagatggtcttacagaaaggtagctgagataatactgaaggctctttggtcccctattctctgagtatacacatggaagagctacagctagagttaacggtgaagtctgccctaatgccaagcgtgaacaccacagcccttttttttgagacatggttcatggcccaggctggagtgcagtggtgtgattttgactcactgcagccttgacctcctgggctcaagggatcctcccgcctcagcctcccaaagtgttgggatgagccactgtgcctggtgccattatttttttaaaggatggattatattttcacatcctgacaccattcagaaagtgaggggtcagggaggccagggaggaggctattcagcagtgtgacgtcaattgtctatttgttagccacagtacaggaaaatgctatactaagcacaaaggtgaaaggactgggagactatgtacaattgacttgctttaaagagtagcacaatggagccattttaagtagcttttgagaaacctagaacaagggttcttaggactgcattcttcccttttgactacagagttattataatcaggacttaaaaagaatagtatttgacaaggtcaaagatcgaggatcctttcttcttttttactccaaacatgatgatcttgatgaacaatagtttttgttgatctgatttttagttttcagttttaaataagtaaaatcttgttcaccttggagagatttccccctggagctgtgttgttaattgtgtcttctttgacttttcctaatagataatccagcaggctggccaggtttggttcccagattctgcgtttaagacatatcaggccatcaaggacttcaaccgggaagggctgcctctgatggtctttgccaactggagaggcttctctggtggaatgaaaggtgactgggctgcctgtgggctggaggggcatcactgattactgggcactctgcggcagagggagggtatagattcagcagaatctgtgggtgtcctaatagcctaggctttttggggattctgccctctctgagacatcttttgagttgcaacttgaatggaaaaaagtacattttataattccatacagaatttcagaataatctactactagtgttattgaggtgacctactgttgtggatctcgctctcacagatggatgctggaccattctgatggtgctggggaaatatgattgtgactctgtccctcttttctgggcatatactttgttggtgttactcctaatgttctacagtgaccaagacagatactgaaattagcatttactggaagaaaatgaacaaattcagtaccagaggctgttcagtaccagtggcaatttgtgctatgttatattattatctaacaacagccctgggcctgtggctccagcatattagaccattattacaaaggctctactccatgctatgggaattgctaagtaattaggcagccagtatcaccatttacggagaaaccttgatgtgtagagcgactgtggacactacagggagagccaaaggaaacactacctcttacagtagtgaagccctctgtcccatggccagataattcatggccatgctaagccagagactgcatacctggagggtatgagagtatgctaagtataaattccatctgtcttggggagaatttggggttctaaagcaataggatagggccaggcggggtggctcacgcctgtaatcccagcactttgggaggctgaggcaggtggatcacttgaggtccaggagtttgagaccatcctggtcaacatggtgaaaccttgtctctgctaaaatacaaaacttagctggcgtggtggtgggcgcttgtagtcccagctacccgggaggctgaggcaggagaatcacttgaacctgggaggcagagattgcagtgagccaagattgtgccactgcactttagcctgggcaaaagggtaagactctgtctcaaaaaaaaggaaaaaacagtaggataggttaggggaaggagggaggagtagaaacttttggagtaaatagtgattagaaaatgcttaggatggccaggcgcggtggctcacgcctgtaatcccagcactttgggaggccgaggtgggtggatcacctgaggtcaggagtttgagaccagcctgtccaacatagtgaaaccctgtctctacaaaaaatacaaaattagccagatggggtggtgcatgcctataatccctagctacttgggaggctgaggcaggagaatcacttgaacccaggaggcagaggttgcagtgagccgagattgcaccactgcactccagcctgggcgacagagcaagactccatctcaaaaaaaaaaaaaaagaaagaaagaaaaagaaaagaaaatacttaagacatacaaaatgtgaaacaatgaactctcaatagggcacttaaaaatagcttagggcagaagcacccccagcctatgagggaggaaatgcctggggaaactaccagatggtcagttatgtggcaagagggatttgaaatttttgccgacaatttttccttactcgtctaggaagagccctgtatggccaggcctccttggcaaaatgttgactaggttgattgtgtgtgtgtgtgtgtgtgtgtgtgtgtgtgtgtgtgtgtttggttgaaaagtttacctttgcctgtatttgctggagaactaccacattttatacttttcttgggggagacttggactatatatccaaattaatgattgtatatattttttagattatcaaggtgaattattttttgaccgagataataaattagtggaaataccatgagaaattgagagtatacggttaagtcaatcctacacatttttattgagttctgtgtgttaggaactatgctagccacttcagagaacaaaaataagtcaaaataagtcagaaacaatacattgcttcacagagacaagaaaaatgtcttgagcaaaatgataaagccataatgtataaacaaaataccaggatattcaaaagaagatggtagtagtatatcaaagggaaggggggcctgaaaacccctcattcatatatatgaggttcattcagcattagatttcacttgatcccaaattccttggctctaatatttttgttgagacctgggagagaatgctatgctattactccttacttatctctttgtggggggcccactgagaatgtactcttcctgacattacttcagagtgtcaccctggatattttatcctaacgggagttcagagttcaaaagtttccaatgtgccacttctaggaaaagcttcaattctgctacatattttggctcaggcccagattggctgccgcgctgtaacagtaagaacaacaacaattaagattcattgagctcttttcaccagaaacttgtgctaacaattttacatgtattatcttacataatcatcacaacaagcacctctaaggggtaggttatattgttatgaacattttacataaattaagatttatgtaaattaggttaagtaaatttcccaagctcattcagctacaaaatggcagagttgggaaaggaaggtggatctgtctgacttcctgtaacacagttggctgatgtgatgtagctccctgtaacacagttagagcctaaaaccagaactagatctactagaatatccctataacagaatgtcaaggttcctgaaaaagttattatccacctacttcccctctactttggggatgtccttggttattgtgaaaagaaatttcaagagctcagaaatgagttcattttttattgtggtaaaatatacataatatttatcactttaattatttgtaagtgtacaattcagtggcactaaatacattcacagtgttgtgtaactatcactggtatctacacccaaaacttcatcatcctcaacataaactctataccccttaaacaataagtacccattcctttctccctgctgcccttggtctgaaatgagtttttggcctgatatatagaccagggcaagttctgtcttaattttggtgctgatgcatccttttacacctcacgtaagacaaataagacttagggaagatagagatccctgtgaaggtaggagggggaggaacagtgcctttcatatttacatacaggtcagggtgttgtattatctcatgtaaagggacctaaactgagggcctcttgtcattcttcacatcccttggggagatgtttgcagttttggtttcaatactggctggggattatgcagggagggaaaataaacaattatgccatccctcagtgcacacaaacacacagccaggagccgactgcactgtgggtaaaatgactccaaaattgtgtgtaatgagtaggaaaagattagagacagctcttgctatgctgaaaattgacattagtgaagggaaaaaaaaaaaactctactagtcggcctaggaggtctaattcgagcagtaaagatataaataaataaataaaagcatgtcaagatggtattggtgctttttttcaatgagctctatctggccggaaggctattcagcataatgcaaaattaaattataaaaactggctgaatatttagatggaagagccatttggaagcagtttatttagacgaaccggcaatgacccacaacagggagacatcaagcgtgaaatttactagaaattagcaccagggtcccagcctcagcatgaatagcttgataggatgcaaatcccagtgatattaagctgcctcactgctggtgctacagggtcactctcagttggcttttcatgttatacttattattttttcctgggacaggttataaataacaataaaaaaaatttattgaaaactttaactggaatgaaagtctattttaaagtctctgattactaggatgttgaaatacagtgtcagccgatcataatgaactaaggagagacattatgtatatgtagcttgtgtatggctaatgtttaccttcagtttctaacagataatcttgcccaagccaataagatctgtttcattttcaagagtgtgggacactgtggaaacactctgccaccctgttcccttgtttgatacacatggctgccacggtttatccatgtttataacaataaaagccctaggcagggttggtgcctaggtgctgagagcacactgcaaaggttgtgtgtggtcaccattcatgcagatgtgctttgcccagcatgctagaaaactccaagctcccgcctctccagtgaggaacctatcagtattttccattcccagttgcgtttctcagggcctgagaattgacagcacgtgcatagctttaaaattctgtagactgatttctaacctaaacccttggggatcgcccctcccctgctgctattggctgtgcttttgctctgtctcttaaatacgaagggatttcagacaattgtgtgtcagattgttgccaagtgtttcaacctgcctttcaaaataagtggtttggggcagctgcagttcagtctgagcatgtcgattacagagtttatttgtgtgtttgtttatattttaatagcctgctttttgggtgttttgatggttgggctgtgggtctataggtgttccaagttagatggaggcaatatattagtcccaaacatgtcagctttaacaaaccctgatgctcctttcctactcacagtcttggggccgaaaaatacttgtttggcagtcagatccaagcctcacacaggctggtagtgttatcagtatagttttgaacatttctgaacacagaggaaatccagcagcagttgggaatattcagtcatgtattcaagtctctttttctggttttattttactcatcatattagatgttggaaagcagagtaccccagtctcatgctgtctctcctagcagtaagaatgaagtagtagaggctgggcacagaggcttacacctgtaatcccaacattttggaaggccgaggtgggcggatggcttgagctcagcgagaccagtctgggcaacgtggtgaaaccccgtctctacaaaaaatacaaaaattagctgcgcatggtggcacgcacctgtagtctcagttacttggggtgttgatggaggaggatcgtctgaacccaggaggcagaggttgcagtcagctgaggtcgtgccactgcactccagcttgggagacagagtgagaacctggcgcgccccgctccccacctcaaaaaaaaaaaagaatgaagtagtagaatgtggacattagggccaacaagatctagatttgagtcttatctccaccactcactcttatttaagcctcagtttactcacctgcaacttggatatataaataagataatgttctgatgattaaatgatttatatgtgtgtatatataatcatgttccctggtacacaataagctagccatgatgatgacaaaaaggagcccacgtccatttcataaaattaaaaatcacacacacacactcatcttcatttgaaactgtttgcatatactatgaaatctagtatttttttaatagatgaatgaaaatacattttaaataaaatctccccttctttttgagatgtcaatctgttaattataatacagagatagattttgttgtagctaagtctttaacaagaagaagtgagtaaaagagctggaaactttgtcttcacttacctctaactttttttttctttttcaggtagaatgactttttgtgctgtcttttattgctttattttctccttttatctatacctttcatttcctctctttgtatgatatcattgagggacacttttctgttacttgttcggagactgtactcttggcagcactgaaaaatgtactgctaattacacaattattttattatgtagcactggttgaaatatccactaaagaattaatttagttaaaataatttgaactgagcaattattttcataactacagaattagcgtaaagcacttaaagtcctttattccctgctcttcatacagcagttgttaattagcagtaaatttttttggtcttagcttttctcccaaaggaataaatgtcttcactctgatcatatacatggagtacatatcatacacattccacatagagtagggggtgttttctggggtaacttggaatttctgaagtcttcacagacacaccaggttggggcagtggagcatgtgccttgcagtgaactgtgctcactgatagtttgtatattaagccatttttactttggagaaggtggcagtttaatttgccagtaactacaatgaaagcaatttctatttggtttgctcttaacttcctgaaaaatgcttctttgccttggattcccagaattgatttattccaaattgagatcctctctttgataagaaagtttgatctcagttgaacctgttatttggtatttagaaaggatccattgtggctccactgaagtactcattaaacatctggactcataaacctaaagctttagcaatggacttcagtgagctgggaaatgggaagtccataaaaagttgggaaataaataactgatccagttttccagggactcactttatgtgtacatcatgggtccttttcttcaggctgctcctggctttggagggattacaaaatgtactcttttttttttttttttttttttaaaggcagggccttgctgtgttacccacactggagtacagcagcatgatcacagctcactgcaggtctcagcctcctaggctcagatcctcccacctcaccctcctgggttgctgggactatgggaatgtgccaccatgttttgctaatttttttggtttttgtagagatagggtctctctctgttggtcttgaactcctgggctcaagcggtcctcccacctcagcctcccaaggagctgtgattataggtgtgagctaccattcccagtctacaaagtgtagtctttagcagaatgaagaggtggttcctctcttgttttttgtttattttgttttatgttgtttttgagacagggtcttgttctgtcacccaggctagagtgcagtggcaagatcatggctcactgcagcctcgacctcttgggctcaagtgatcctcccacctcagccaagtgactgggactgcaggcatgcaccaccatgcccagctaattttttattatttgtagagacaggttctcactatgctgccctggttgggtctgttcttctcatgtggctgtgtggtatttcctaagtatttttaaaatttttctctcattgataccctataaaaatgcaactgttaaagaatttgtctttctttctcattatattctttccagagtatataactaatttattcagcattcattcattcagcagatatttgttgagcactaactatgttcaggcactgggcagggatatcgggataccaagatgaaaaatagtttttgaagataaaatttttaaaggatcaatttccattaggtgcacatttgaagagctcatcctatgctaagcatcatgagaataactgaaaagaggtagaatagttccttcctttagtaaacttactgtagtgggagagcacatattgacatgaaaaatactcaacgtttgtagagcaaatgtgaattaatgtggtgaaacgtgagtacagaaattcagagaggatataaaatggaaaggcaatctggaagacttacacactgtatcttgtgaaagacagtgcatctctctgttgctgtcttgtgcttttgaagatcctctggagtcttgaatgggatacaggtcgatactccctttagtctatagggtggccaaacaggaggcatagtataaggaggctcttcgtggccagaggtcctgaacagtgtttaaaagtactgctttgaggaagagaaatttcttgatttctaatttgtctcattctccatagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggtagcgtgccttccacatttccattcactgcctttagggaccctgtagctgttggtttcctcctggagaatgttacagccatggcactacagcacccacatcctgtgattccaaaccaaagctttttccttccattacagtccaggtcctcactctagcatttcaggaagctgaagaccatggtgtttgtagcacccaaaaaaactgtaagggagaacctcaggcttattgggaggtggtacctgaaactacctaaataaaacagatctaatctggcatcctttcatagtctgttctcacctctttcctaagtaaacttcaaaacgtgtttctttgacattttccaaggaaattcttacctccagtcgttttagtggaccgcccgcttctctcttgtccccccagattcagccttctatgtcaaaggctgcttaggagagtccagtagtttcactgtcaaacctctaggctgagaggcttattatttacattctgtacttaggggtttattattttttaagtcctaaactcatctgatatcagatcagagacaattcctctatagactttggaatcagactgtctggtttcaaatccagttctgcctcttgttatatttggacgagtctcataacttactaaactgtagtttcctcacctgtaaaatgggaataatcacagaaccttactacatagtagatggagactgggcataggattgttgtaaggatttatatgtaagttattagaacagtgccatgtacatagtaaacattatctataatttttttaaactagaaagctgtgggtttttttttaaacatgtttggggtaaagtttctggggactgaacatcattagtatgcactaaaagtaaccctgagacctttgactctgctcatttccatagcgctgggcagaatgttttacctcctacttggcctggcttagtgtgtctgatcagtgtcctacaagcagactgacagctgtggtataggtgaggtagatagatagatagatagatagatagatagatagtattgatgaagtattgcccttcattattgtacatcctacgtgatggaggtggttcccctgtcactgtgcctacagcatttttttcccctggaaaataatgtgattcctgttactcttatcagctgtaggtggtggaatctgtattcttctccctttgaaatggaagtcgactggtgtggtaatgagaattattttaattgctttttgccaggcctttctcatacctcacttagacacttctctggtgcctactgttctccccggggagatgtctgttaaccataggtgggcaaaatgataatgaagctatttcctggtctacaaattgtaactggcctcattctgttgtctccttcctttaaagtgcctctatttctgttttgttttttctttctttctgatccaggggatctgttctggagccagaagggacagtagaaatcaaattccgcagaaaggatctggtgaaaaccatgcgtcgggtggacccagtctacatccacttggctgagcgattgggtatgtctgcttgtccttctggcaaatcaatgagccattcagctgatttgtaatgagtgcattcataggccaggggaggaggcactgaagcatttgatcaaattcatgataatctttatttactgtcctctatatggtaagaaccctggtagaatgaaatagtgtgtataatagggaaagtgagccctaaaaaagcaaaagtcacctgattttttttcctgatatttccttagagtacaaaaagcccgtctttctaagatgtccttgtagagaatgattagctagagttgctgctgggggcaggcctcaccagagaatatgctagatttaaatatgtcctgtttctgcttgtttctttggacagctcacttcatttctgagagatgggatagaaaagcaggagtctttacccaggtggtgttccggggtcttcctgagctagagaaatagaagtaaagattgcgcactgtgtgcttccaaacagtagctgcagccagaatagccctgagagcaggcgtgcttaatgcttccagccattgctctgttgctcatttgttttcagagcttttggaagccacttggcaatttgaacataggactaaaccatgggagtcctgtgttgagtccagagtctaaatgagtttcagattcttttaaaacactgattttctgcccaggtctcccattgagccccttgctatgttagtaaagataattgctcgaggttcttttgtcagttggtttgtcttgtttttgtttttttctaaaggaacagagattgcctttaaaaggtagtgaaactcagtgaatggagaagagagatgctagctcatttatgttccaagtggtaatttaattaataaagtaccatttgtggactgtatatccccaccatccagagacagaaaaatcccgtttgcctacactgtggagactgtacatccaggcatttggagccctgagccaggttgcctgccaaacacggtgacttgggttacaagaaaccctgtttgtgtcccattgtttgccactgggtaacagccaccaataactctaactcaccacagtctgatccttttatggggaatgcacacatacaagaaatgagagttgtttctaaaatctattgccacccagaattgaggtgggttttttctctttcttttccaaacagaataattacttctgaccaaccctgtacactttaattaaagtaactgcagctcaagagcaagttacttacaactgttcatagagagagctctaaaagcttcagccactgataagcatctcacttagatggctcataattgctcccagcatcccccaattgttgccgctgtgtttaccactaattccatacaaaggcagcaatgccgcaattgcaggacacagcaaattgcatcattttcctttttcctttttttcttcctttttcttttcccttttttttttctttttgctggttttctttctggccaatttaaaatttgtcaaagtcggtcttcttctggatcactgccctttgatatttcgcgcactccatttgccacaaacaagccgcagggccgcagttcatgctgactctagcagaagcagagagagctccatttatcttacactgcctgctgaattcctactcattaactgggggttcactgcctctttttaaccccccaatggctgttatcatcccttcagagtaactgggtggtagggagagggatcctttctccttttgcagaaggactggatggtgaggggtgtggagataaagcttctttctcttcaaggaaagtgatgtcgctcccaccttcaaccagcaccttttaacttttgaagcacatgaaggggagagggaggagactcccaagtgatagccgtttaatcatttgttacaaatcatctcattatcaatttcctatccgcattggagaaaaccatatttatttaaccttgaccaaaatggcacttgaaaaaggacccttagtctgctaaatgtgaagcaggctctggcctagggcagcttgggaacatgagcagtggacttggaataagaataacgaactacgagtcttgtaaattatttaacttctccgaacatcagtttttttccaaccataaagtggagatcacacctctgcctagctaatatgaggagcagatgagcatgcatttacttcattgcatcattatctttctgtcttaatcattagaaaaagcagatggccatgtttggtatccagtattctctgtggctcagtcccacatgtgaaaatatgaaagaaacagaagtatagtcctgtctctcagggatatcctatacgggcagctgtctctgcgacaaagcaggtcagcctagatataacaggacatattatgaacccagttcctttggggttcacaatgattctggctcttttagtttgcctagaaccaaactaccaaaattctttttcacaaagtgggtgaaaatggtctcatttttcagactgggaaattgaggccaaaaaagtgaatcatctaagatacaaaataaataaatgtacatcagagtccagaatggaattctcattctctgtgttctccttttctcaggatttcttcagatttttcctcaactgaatactgagcccgaactaaattaaacaaggattctttccttttgtaatctaaagccatttccacagagaaaatctgatttaggagaaagcctgtaggagtggatgttatcttgtgttgccgttctctccccaaatctgcctctttactggggagcgtgctcacagatcacttagacaaaccagcgcacaactgattgactgtgttcaaaaacataattactccgggcacggtggctcacgcctgtaatcccagcactttaggaggaggaggcaggcagatcacctgaggttgggagttcaagaccagcctgaccaacatggagaaaccccgtctctactaaaaatacaaaattagccgggcatggtggtgcatgcctgtagtcccagctactcaggaggctgaggcaggagaatcgcttgaacctgggaggtggaggttgcagtgagccgagatcgcgccattgcactccagcctgggcaagaagagcaaatccctgtctttaaaaaaaaaaaaaatcataattgctatgtattttataagaatgagtaatatttgacttctgagcagctaacttcatctcttctagaatttttatttttttaaatggccttttgtcatcttacatggttagtttgggtggaaagatggtgaattactagtttgcaggtctgtgattataacagaaaatatgtaaatagtgcctacactgattcctaatagaagtaaagggaagaattacctcagaaagaaaagtgagcaaagcccaggccccagagtcttgcattgctgaatcagttctgaccctgattcacagaaccagggcttggtagagtcattgcaaggaggagaattacttcctaccatttggttgccttaaggaaattaaatttcttctctggaaatggagccgcagccctccaagtcctttttgtctctctctgacatccttctactgcctcacaaggccaggagcagggagagtggctgtggagcgggacggccttgctagcctggcctcttgagtgctgtgacctgaggtcctctcctggatccttcccctcctcttgtgttcagagagaaatgacaaatcaatttagatggagagagaactgtccagcccaagtgtgaagcaattgtaagttccccactgtccctctctctcaaaatgaagagcacctgggcaaaggagccgcttaggggaacttgttcttagttgtggccctgttcccaggcagctgggcagcctgccatgcagcaccgcactgcgcccacacagaacatgccctgactgcctgccacagggagcagcagcatggactgagtgagcactgctgctggcccttgcctggtccttctaggcctgcccacacccaccatgccttcagggtcaaggttgccccaggtgcagatatggagcattgtggtggcaggtgaggatacgcttctctgtaaaaatcttcaggaatgccttcctcccaagccttctctagcagccagaatgacaggaaaaggactgttccctgggctaaggggacttaagggttaagctgcttttctggcagaggtgatcaaagtatctgagctgtgtttttccaactcttatgtccatcttcgagaggctgaaagctgaaaagagccagagttgcttgtttgaggcagaaagtatgtctttgcctggaaagttaagactaggaaagaaagaagttccgatacgcatgccttagtgagtggtctttcacctctcacctgttgaacttggagtgtcctcactgacactatggccactgtgtcctttgcggtaaggaggctgatgagaaataacacgaggctttctatcacgaaggtagatatgggatcttgcctcctctcttttgttagcagtagctgaaaacctacccctcacactgattcagaagctatttggctcggtgaagtttagtgcaatagtgacaaaattttctgagaagagaaaggggtcattttagtttgatcctttaatctgattgtatttataaaagcacctgggcttgcctcccccaaggaagcagtgtttcacaattctgtatggccagagggacctggcaggcatttagttagagggaacccaagagaaagctgtcatcagaatgtgtcttggtcccaaatgaccagatccccgtatcctgacctgccagacatagggagagcaaattagggaaggaaaataatgaagactacagaggcatatttctaccagaagaattcagagaattctgtgctgttccctgaccttttttatatggatatgtctgcgtggaaacacagggacgggactgatgggggagcagtatttttttttattcctgtttggaaatctctgggttttctattaatataatgatttttaaaaatatgaacagtagagcactaacactgttgcagggaactttagggttaaacatcccctgagaggattgctgttaaaatcaatatgcaaatgtgagtgtatttagataggtatggccccctttgaagaaaagcagatatatgaaaatggggttttaaaaaaagctagatacattgggagaaattattcccattacaaaaggattatttgccttaccaaaggattcactgcagggttcctcataaaatagctcccttaaggcatttaaaacaggatctgatttacgcagtttttcaagaatgcttttgtgtaaagaaaggcacacctgttatggatatagaaatagttttgcaggattttttttttttacctatcttactatgtttatagaaaaatttctttcaacatagaaaatgtgattacatagatcttttaaacaactgcttgtgtttgtacttctgaatcttaataagattccagtcttttttatgctgatttttcagtctcaaggttgagggatgggagtatgttttaacatctgagatattcaggagctttctggggagggtggtcttgttcttatctctagcatcataagtattgaaccattcaaagcaaattgctttctttctttctttcttttttttttttttttgagacagagtttcgctcttgttgcccaggctggagtgcaatggcacgatcacggctcactgcaacctctgcctcccgggttcaagcagttctcctacctcagcctcctgagtagctaggattataggcatgcaccaccatgcccgactaattttgtatttttagcagagatggggtttctttatgttggccaggatggtcttgaactcccgacctcaggtgatccgcccgcctcggcctcctaaagtgttgggattacaggcatgagccaccgtgcctggcgcaaattgctttcttaagtaaaggaagaagggcccatcaaagttaaaattggatttaaatttacataggcttcttagtataactgttttggttttgtttttgtttttgagatggagcctcgcactgtcgcctgggctggagtgcagtggcgtgattttggctcactgcaacctctgcctcccgagttcaagcgattctcctgcctcagcctcccaagtagctgagattacaggtgcctgccaccaagtataacttttttaaaagttgagaatgtttttaaaaacactttaatatcacattcttttataaaacattttccctgtttgccagactgggattgttgttacataaatgaggaactcaactcagaaaaggaaaaagatttctacaaggtcgcctagagcctttggctgagcagagaatttttagtctaccagtctgatttttattccaagctttgaagatgtcacctcccccaaatcctacttttaggatgtagtttgttcatacacagactagggctgaccttctcctggcctatttaagtgatatggctgggcaaaaaattgcctcctgctgcagaaatcagccgtttcctctgggagtttctctttagcttttttttttttttttttttttcggtcagagacagattctcactctgtctgccagcctggagtgcagtgtcatgatcacagctcaccacacctcgacctgtcaggctcaagcaattctcccacctcagtcccaagtagctaggactacaaggcatgcgccaccacattccgctaattttaaaatatttgtagagacagaatttccctgtgttgcctgggctggtctcaaactcctggcctccgcagtccttcccaccttggcctctcaaagtgctgatattacaggcatgacccaccgtgtccagcctctcttcacctttgataccatggaggagaaatgtggcttttctttgtatcctggctccagggaacacctgataggccactgtgctgcggatactttcaagtcaatttgaactgctttgtttaaggagcatgggctcttaaaccagattacctagtccaaaatcacaactccactgttgcctagctttgtggccttgggtgagttacttttttgtgcctcagtttcctcatcttttaggattgttgtaaggattaaatgagataaaaagtactttaacagtaccagcacacagtaacatctcaatagtgttagctcttcttatttgaccagtgatatttcgtctctgtttaactctttaaattttttaattaaaagtgtgcatttttaggatttcatggggacttattttttaagagacaaggtcaccctctttcacctaagccaaacttgtccaaccgtggcctgcaggccacatgtggcccaacacaaatttgtaaactttcttaaaacattacgagattttttttacaatttcttttccagctcattggctatcgttagtgtattttatgtgtggcccaagataattcttcttcttccaatgtggcccaaggaagccaaaagattggacactcctgacctaggctggagtgcagcagcacaatcatagttcaccgcagcttgaactcctgggctccagcgatcctcctgcctcagccaccagagtatctctgggactacaggcacgcttcaccatgcctggctaattttggggggcatgcaggaggaaagacagggtctcgctctgttgcccaggctggtattgaacccctgggctcaagccatcctcccaccttggcttcccaaagttctgagattacaggtgtgagctaccacacttggcattttgtgtgtgtgtgtgtgtgtgtgtgtgtgtttgtgtgtttgtagagacagggtcttgctttgttgtccaggctgatcttgaaatcctggcttcaggcagtcctcccaacttgcatagggactttttattttggataggaaaggatgggagcacctacctttttactcccactcagccatttcctaatgtagaattctagaaaagaatgacttttctctctgtagcatattcttaaacacactcacacacgtgtacacaccaacttgctttcctaaaatccctgaggccctgcaatctggctagaaaagaaagaaaaccatttcaagatatttaattgtacagggagcttacagcattgatcgagagcttagctttttacaatagtccagtgaataagaaatgctcctgacaaacgatcaatgataggataatcactctttatccccctcctcattcttaccttctttctttcaggagaacagggttcagaagtcaaaaatctttatagacgccacttttaaattaagcagaaaatagacattgacatatttgttaatctcccctaaatcattaccggggctggctgctttgctgtacaaggagagaggggccctcggtgtgcaacacatgatataactggcttaatagcagccttttatttttagaaaataaaattttaaaaatcttttttcccctaaaacaaagcacacaaatccttgaccttcacatgggcatttaaaaacacatatattctccacttcagtcttttccttgttttgatgcttttttgaggtgggtcttgaaccataatcagaggcattactgaaggaatcaaacaaggtaggctttggaggaatgccctgcaatcttcctagtctcaggagggccagagcattacaggcatttattttgttattctttcaaagctctagaatagcttgattgagagggcaagacctttgttagcccagaagccagcatcctccgtccttccaacttggcgaagccaaagcctggtttctgaaacactgtcctcagcccgtagctgctccctcttctgcagccagtgctgagccttgctcttaactccttgcgaacaacaaaccaactctccagctggtttccctatagtggccactgcaggatatctgcttgccagccttcaataccatttaatgtggaagaacacaggctttggagagagccagacccaagtgtaaatcctgactttgccacttaagagctggatgcagccaggtgcggtggctcacacctgtaatcccagcacttttggaggccgaggcaggcagatcacctgaggtcagtttgagaccagtctggccaacatggtaaaaccaaatctctatgaaaaattcaaaaatcagtcaggcttggtgacgggcacctgtaatcccagctacttgggagtctgaggcagaagaattgcttgaactcagggggcagaggttgcagtgagccgagatcgtgccactgcactccagcctgggcgacagagcaagactccgtctcaaaaaaaaaaaaaaaaaaaaaaagagctggatgccattggggaagtccctttacatttcagagctgtggttttcttacctgtaaaatagacaccctggcataaagttgagttgtcctaaggattggagatcatgtacctgaagcaactgggaaagcacgcagtaacgttgaagtattcagcttggcagcagtgttaacagctgaccagatgtaggtgtgtagatctgtattgtgcttggtgattatgatatgtgatcctgaaagatttgagtgcagtgagtggtaaatgctcaataaatggtgtgttagatatggtccatgtatatgtgcgtttagccatgtcagtggtcttgccatccctttgctccctgcagggctgtgactttacctattattgtattagttcttgaactcacagtaacaagagacacaactcttaaatcttaggcctgcctaggaaattgcatctgaatgggaactattggagacattgtcctggtcttagttatggaattgggactaagatagaacctttatcagccaggagcccaccatcatcacttagcctctcagaaattaaagggacactactactgaagcacgtgtcttctgcccaagtaagcgagaagagacagctaacagtgttcaaaagctttgggacccaaactgctgcatttgagtcttggctctgtcacttgctagctttgtgaccttggtaagtccataaattctcagtgcctcagtctcctcacctgtaaaatgggaataataagaataccagactcctaaggttgttgtgataataaattaatagatataaagcacttagaatggtgcccagtaccctataaatattagctttgattattgattgtatgcattggatagccaggaataagttttcttttccagcttgcctaatttttaaaactttccaatttcacaaaaaagttacaagaataatacaatgcttttttctcaaattcacctattgttaatatcccaatgctttattatttctgcatattcacatgtgtacatgtatttattctctcttgctccacacacatatgcattttctttgagccatttgaaagtaatctgtggacctcttgcctttttttttttttttttttctgagacagtcactcaggctggagtgcagtggcgccatcttaactcactgcaaactccagttcccgggttcaagcaattctcacgcctcagcctcctgagtagctgggatggcaagcatgtgccaccatgcctggctaatttttgtatttttagtagagacaaggtcttgccatgttggccaggctggtctcaaactcctggcctcaagtaacccacctacctcagcctcccaaagtgctgggattacaggtgtgagccaccccgcctggccctaatgcttctttattcataaatattagtgtgtatttctaagaacacagactttctcctacataaccacaatacatttatcaaaatcaagaactgtaaacattgatactactgtctaatccatgattcatattaaaattttaccaattgtctcaatgtcctttttagtttttttttttttttttgaggggcggtctgagatctgatctaatgagcatacattgaaattcattgtcaagtatttttggtctcttttaatctggactgattctttgacctttgtttttcatgtttttcacatttttgaagagtgagccactttttttgtagcatgtttcctcagtttgggtttgtggttagatttcgattctgctttttgggcaggaatgttgcggaagtcatgttctgtccttctcagtacatcatcaggagtcatggtatcagtctgtcctcttggtgataatttaattacttgcttaaggtgttgttcactaggttaatccacgataaagttaccattttcccctttgtaattaataagtgatttgtaaggaatattttaagaccttgtgaatattctgtttcttatcaaactttcacccactggctttgacatccattgatgattcttggaagagtaatttacagtgatgcttgtaaaacggtgatttttctaattccatcatttccgctacacttattgttcttctgctggaagagagagtgttccctttcccttctccctcatttaattacttatatgagggtgaattggtagattctagtttcattccacaaatattctgtctgttaataaatatcattatttattttagtgttcattgtcccagaattgggcagtgggaacacattcaaaactggctcctgcatttttctaacatgtctcaatcgttttttgagggcttccttgtttttttgtcacaatataccccaggttcatctgatgttttccctacctcatccctagaatcagctatttctccagggaatcttggtttctttctgtggagaagggaaaatatttgcttccctaacaagggtgttctgagaatgtctcatctccgaagacaccagccagccctccatccctcagccctcctcccatcagccctcttgccatcagccctccctccatcagccctcctcccatcagccctccctccatcagccctcctgccatcagccctcccgccatcagccctcctgccatcagccctcccgccatcagccctcctgccatcagccctcccgccatcagccctcctcccatcagccctcctgctatcagccctcctcccatcagccctcctcccatcagccctccatccctcagccctcccgccatcagccctccaggcagatctacactagaatgcaatgggcctttgtgtcatcccttagtgtggggcccggtgcgttcatgctgttcaggtgttttggaaggaacactactgaggcgccggggcctaaagcagcagatcagtggcaccttcatcacagttttaaaatggtgatgagcttaaaaaaagaggtagagttgggcatccaaaaaactaataaaaatgaaacttaagtactatagttacatccctcctctgttaacctgtgtttatgtataatacggctcagtcagcagcccaaggctgtttttatggcatatgattcattgtggtgtaaaaaacaaggcctgttcccagacaggcatgcttgaaatagaccttcctcttctgcatcctatcacctgtgctcatgtatttatttgtcagctttggtgacaaagcacttcagggtgtccctaacaccaggggctgtcacctattgctccttcagctaggcttactcctccttactaggcaggcagctaaattttcagtattgattgcagatcccattctgagagtaattaggaagaaaggcacaccatagcaacacctctactgggacactattgattgggggaggggtccctccttggtataaggggttccaaagtctcctgtctgttgagtcagggtaccgtgcgcagtgatccaaatgaggtttgccaactgcctttctctttttacatcctccttctcctttagcctaagaagtagaatgtctttgtctggtcagggactggctctggcagtagcagcccaggcgggagagcacaggctaacccactgagctgacacaagatgtgaggatctagctctaattagattgagttctactaattagaggttaagagtatataaacctgagattagaagccatgaagtactatggcttgtaactttaggagttattcaggtccttgccaagtttggcagataactcgcatgtacacggaaacaggagctactagtttgtgctcggagtttaggggtgctctcaccacatcccacgtgtggaatagcccagctgctttgatgctggtcagcagggatgggcatggtgtcagtgtacaagtactggcctcaggggaaggaggagcctgggtggtgtcagcaatatgcagcaggcctctaggtcgctacttgcaccttctcagggagaggcatgggagaggggctgccatctgccttcacacttgtgactgccacagggaaaagagggcatgtgggcttcttgtggcaaggtaaagactggtgtggcatcttgtagggccctgttaatcagcaaagagcagagaagacaacggagagccaggccacagagggaagagggggcaggctgatgttgagcttcccgtgattgtggctgcttttgtgcagagagattcctggtcattacagagtgtgacgggcatgtttatctaattgcagggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgtaagtacaatggttgccacttcttgtcagaggcccacatgtgggcaagtgtgtgtgtgtgttgcacacaggctcataagcagggagctatgagggccaaattaaaacaacttctgcagatcaaaacattttcaatattttttagattttcactgtttctgtaactgttatcatcttaaaacaatgtataatttaggtttccattaattcctcaggaggcaagctgcattttactggtgggaaactgagtcacatgtgacttcattggtgacgggtcctcaggatgtgggttactatagggtcaaggctcccgcagcagctaattaataattgatctgcaagttgtttgatccatcttctcaaaacgaatttatccttgtctggttatctgggaactcacagcctcttccccagaacatctcagccatgtgtgggatcagcattagccaggcccatggctgtgcacagtgctgcagacagcagggcatgtgggctgcatttctgccctgggggacatctggaagtgctaggagtttacagccagctcttgggtctgtgaagggcttgcctggagaatcagtttttatgcctgtgggtttccctccagactgagcattaagcaggaattaggactgggctaagtttattcttctctgcatgtaggatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggtaggtgggacactcaaagagaagcctttttgctgagttcctcacaccacctgagggctgcaagtctcgccagcaaagagtccacaggcctctaagggcaggagtagaagggaaacatagagatccaagctgtttcctcccccagctactccccctaacatgtcatgtcacgacatcttgttagaagaggtggtagggcatatgttgcagcttatgcaatcattcagcagacctttttgaacacttactgggtactagacactgcatttgcttctgggggcatggcagtgaaagaggcaaatgttgttcctatccacatagagctcaccatctagagggggagacaaataaagaggttatgcacaatagtgaggcccatgttaaacacagcaaagggcacagagcacagcgagaagatacctgaccctctctgggaaggatggaggagagtctaagaagccttgtgcagtaagtgatgtctcaggagaggctggaaaacaaagcagaaatgaaccagaagaaaaggctggatttgggggcagtcagggcttaggaggaatgttcctgcagaaggaacagcatcatcctaagccatgagagtaagagtaacatgcatcaaaggaacatcctgcaactgtttcagggcagctcagagactgggtgcctggtaggaagaaggggcaggggcatgatcacacagggccatgtaagctgtcaaggagtttggactttgtcctgaggcctgtcggaaaccactcaggtattttaagcagtggagtgacatgctctgatttctattttagaaagaccactaagggggctgtgtggaggagggaattggaggggctaagagcagaagcctaacaggttgtgatcggcaggagatgccatgactacaactaaagagctgcctacttccaatcagagatggaaggaagtatccacccttatgcagggaaagggacctatgaagctggcattttcttggggtgatctcacagagagggctcgtgacctagagcagtaaccccactgagatggtgtccttggtgctctagcctcagtgttggggatggggcgggtctcaagccaggatgacctagcaagggcaccagcatttgctcctggaatagtgggctgcataagtcactccatggatgggaagaaaaagctggaacttttatttctgtttatttttactaacaaaaagaaattaacctttattagtaattaatatatggattaatcatttacatcaaaaatgcattttatcagaatattggtagtatgtgctcaaaatatatttgtctgtctttctcattgctatgtgatcacaaacatttggtgactaccaggttagagtattgatggagggctgggtggctggtggtggcttgaagggtcctggcccacaaagaggggcactctggcctctgcctagaaagtgttgcctgaagcctctgctaatcgttctcaaggaggagctcccagatttgctgtcagttttaaagccagtgaattggggtgcttctaggattcacctttgtattaagtctgcccattttttttatgactgaaaagcttctttggataaatatttcaaatgtgcagttggggagcacagccttctccgacatttggttcaggttaaggtcagtctgtggcatcataattgagtgagacaattttgtcagtggctactggcagcttctagtggaagttggcattgaaagtcacgcaagtgtaaaataagagtttgtcctccagttaagagtggccggctaggtaaatggagtgtgtgtgtatgtgtgtggccaggagaggcctgcactgcctccctaccacattagtcactaatggacgtgtccagcctcagtaggcacaaggatgagaaggaagtttccccccaggcatgaagcaagtagataggcccttcagcttttccctagcatcctgctcccaagcggacagagcgtctgaagaaataggtcactgccgtctcttatcaatggagagaacagttgaccacgtgtgtacaagctcctggctggaattgaagcacagaagagaacctccaccccgtagctcagtaggaggctgcctaggcactgggggcagccatgctgagcactgaggccatttcccttgtgcccatctacaaaaggcagcattctcctgagttctctgagaggaatgccaaggactgaacgtgaggacgggtaatcctatgatgtcagggcatgtggctttgaaacctccttccatattcggcaggctcagcaggacctagtttagtgtgaggtgggtgataaaatctgcagtgcccttgagagaagaaagggttgcagtgttcaaaagccatctgtgtgcctcagaaggagtgatgtacaatctgcttgctgtttggtgtgggggggggggggtggttcttcaaagaatgatagatactgtgtgttgtgtttctcaagtgcaaagactggctgagtctagaccctggctttgcaccaggaagtgaccctctaatccttattgtggttggttactggtaagaaaagacatttcgagataggcatctattagctatgccttgtgttctttttgttcccagagaatttgttttcttaatcttaatcctgaaaacagaaattctgggacagaaaattgaagacacggtgatattatataactgagcactataattcttttgtttcccttagagatatctgttaccatgagttatgggagtctgtttgaatccactgggacgatcctactgtaggaaatagtaggatttatggttcatagtttcactgcaggcagaagcaaagcatcactacagctccttaacgaaaataacaagaacagtagtttaaattgggtcataagaacatggcacacatttgtatcctgggcatggtttctcacttgattcttagatccaaaatttgaagcctggtttttcaaacaggctgatttattttttcccagaccccaatagtagaaattgaaattaggactctgcatggaacaatgagaatgtgggttttgaaatctcataaacttcgggatcccagctttgtcatttactggcatgggcatattatttaagcctccattccctcatctgtaaaatgggggtggtgtttatgtcatggggttcagtgagttttaaataacatgagtaaagtatggagcataagtcagatgtggtggctcacgcctgtaatcccagtgctttgggaagctgaagtgggaggatcgcttgaggccaggagtttgagaccagcctggataacaaagcaagaccctgtcttcacaaaaaattttaaaatttgctcggtgtcgtggcacacacatgtagtcctagctcctcagggggctgaggcaggagcatcgcttgggccaaggaatttgaggttatagtgagctatgatggcgccactgcaccccagcctgggcaacagagtgagaccctgtctccaaaaagaaaaagtatggaacacaatgtctggctcagtagacattcaaaatatgctagtttcccctgctccatgttagaaggtaaaaaaataatagcaacatagaccaagtcaaaaatgtacagctgattgacctcggcggaaagggggctgactcctgagcacagtgggtgctcagacgctctttggtttggcatgctctcatgttcccacaacccgatgccatggtgcattcttattgttcacacagctacccactcgctcttattctggatttccaagtgaaatgaatgctcaacagaggcccctgtgaggaccataggaaaaagcactattgacagggtcacttatttccactgacctcaaaacctggcctcaggctactgatgaataagtctcatacaccaaacttctcacacagggccaggcagggaggaggtaaggtagaacctggaaagtgttgcttggccctgctatgggcctggagctgagatgggattggctcacaggagcttggttcacaggggtctgatggccaccctagcccacatgtcctttggctattgtactctaaagcccttggaaaaaaaaatcacatcctttcttgggcttctgttggatagggcttagccttgtaagtgtaggtgtattgaaaatgtctttccaaaatatgagtgtaccttaggatttgtatgccatccctacacccatcaggctgtgtgtttcccagaagtctagaaggtcagaaatgggaggagcctccctagctggaggtgtctcccagcagctcccaaggtgagttattagtagggtatagtaatcagggctcacatccatcaggttgtgccctggtcactccttggccctgctgaaccattgtctaaggaggacttaacagctatccagtatgttagaaatgaaactttccaaacaggtcatttagatgttgtgagatagactaattactacataaaattagtgaggctgactagtgcctgagatacttatccactgatgcagacagaaagtgtctgttgaacattcattttaggacaggccactgttgtgatgtagaattattgatattttattgataaaatgttctgatacagatggatatgctgacaggtggcatacgggcccaggcctgtcatgatgttagcagcctagcatatcacacctgtttaaagtccacgctggaatactaggaatgactggccacattttctttttttttttttttgtctcactctattgcccaggctgctggagtaggtatgatgactcactttcagcctcaacctcctgggctcatgtgatcctcccctcccacctcagcctcccaagtagctgggactataggcatacactaccccacctggctgatttttttgtagaggtggggttttgccatgttgcccaggctggtctgaaactcctggactccagcaattccctgcctcagcctcccaaattgctgggataacaggcgtgagccactgtgccaggcccattttcataattttaaggagggaaataataatggcttcttcctgggaataaggttggcctatccttctggatgactggaattgagtcttacaactgttctaagggagcaaacaagaaactgtaggctctggctgggcacagtggcacacgcctataatcccagcactttgggaggccaaggcaggggaactgcttgagcccaggagttcaagaccagcctgggcaacataacgagaccctgtttctaccaaaaaaagttttgccaggcatggtggggcatgcctgtaatcctagctattcaggatgccgatgcaggagaatcacgtgagcccaggagtttcgggctgcaatgagctgtgatcatgccactgtactccagcctgggcaacaggaggagaccctgtctgggggaagaaaaaaaaacctgtaaactccataacccagtggaagggagcttgcttttcccaggtggagcaaattatcccacaacagtatggtaactctcccaggtctgttgagaaaaaccagtggcactatgcttacataagtttgtttatttttgctaaacatgcagttgattagaacttgagacccctttccttcatgtactctaggctgtaatccactggggtttggcggtcattgtcatccagttgtactttgcgtaaacagcagatctttttataggacccatattttcaagcaactgtaaaacttggaatgcgttgccctaatcctgtctgggaacttttcaaaatgtttaaacacctagcatactctgtggctgcaggaggggaaggcagaagagttttctctagagggtagctggctttccagtgtagtgtctgagcattgttggaagcaggcatctcgttagctaatacattacaccaatcaaggagagttatcttaagccacaattaatctgctccctggcatatgttgataggaaagcatcatgctgtttcttaattaaaagcaaacggattaaaaatgattaataagagtattaaatattctcctaaactaaaggctttgggattcttgggtaaatctaaaaatcttggggttttttttttttccattctgaaatccaagaagcatttattgttttatttttcctcccctccaccccaatcttcataagtaggggtatgtgtagaagtcctgaaaccacggagcagaagagtaaattgccaatgatggaaatggaaatgttgaaatttaggtggcgacgtttaggagtccagggggacccatccatatgtggggcgtgcagcaagctgggtcacaagagtgagttaaaaccatgttatgggaaaagcagtgctaccttctccctcgtggataggggctgatgtgacacttcctttccttaggcgcaaaacactttctcaaggcagtttggccttgagagatgctgggagtcctaacccaggcacagagaggagagggtcactcaggtttgcactgacggggccacacaccccagctgaagaattgctgatctgcttatcagtgattagatacagaactgggcacatttgagtcagaaaaagaaatggacaaagaactaaaagagacatactgctgatccttagtccccggaagccttcatctttccaatgtaaaggagttaatttttagaaacagagacgtcgatgaaatgacatacattaaataaccagtcacaactaagtcggcagctaagttagagacaggaagtgacagtctgaaaagaaaccattatatttgaaggcacgagatagttagaaaatagcctagtgctcagttttgtactgcttgaggcctcttgtgatgaagacatttcctctgcagcccagtagtcacagctgtggctttggtgaccttgcttgcatacaggcttcctgtagccacgtctcaaacctcaaagcctcagagtccctaacaaacacacccacctattaaattatagcaccaaactcattgtcattctgactttgacttcgttagtgataacagagaaggatagcgcacctttaaatgacaagctttgtgtttaattacccaaacaaaatgacataaatatgaatgagccctaattgtggtacttggttttccggaaaccattaacaaaacgattcctaaatgatttgtaaagaaaatgagaggagaagagagcaaggagaaggctattaggcttctaacacactcctgaattattatgtagtcaaccacctaggaaatactcagctaaatgatcttgaaaaggaggtgagaggtggtttgttgagactttcagggttatggacgtcttgatcctttcgaatactctcataggtaataaaatggggcttaggtttctgacctggtggctgtaccctggcaacaagacttccctcccatcagttccccgtccgtgcctcatcaaaagacagtgggctctatttcaggagacttcatccatccagtgactgccaggcctcactgaggctagagacttatactttaggcattgtgtctcagctcctctgagagcaaaacaccaaataaacagccttgccttctcaatcacaattttactaagtaatttgggcttttaactggttctctcaaacctgtcaggttattgaattctcttagcctttgtcaaataggtgggtccctagagtctgacaggacagagtcagggtatgagcaccagagtgctcgggagagccccatggagacttcaggtgtacacctgtgtccataaaggaagagaaggagaaggggcacagctcctgcctcgaggcctacttcctcctcctgcacgatgctgacagtgaaggagaatcgtggacacggagcacacttttggagtaagcaagcactccagatcctgaatagtcagggtgtcccggcctggcctgacccctggtgtttgaccaagagtcatctgtttgcaggcttatgtttgggacaataataaggatctggcggagtggctagagaaacagctgacagaggaggatggtgttcactcggtaatagaggaaaacatcaaatgcatcagcagagactacgtcctcaagcaaatccgcaggtgagaccaacgtggggaactccactagagaaggagggctaatttctttggaataaaaagtttccaaacaaatcatgagatgatcgcagaaatcttatgatctctgcagtctcttgctgtttgagacagctgtagttgacccacaggtacagatatggcctgaagcccaattctttttcagctactgctccccaggggcacttagtaatctcagctagatgaaggcttaattcactgtgcccacctcttagctctgaatgctgatactcaaaccggatgaacaactctgggaggaaagctgattgtgtgtgtggtggtttcctgggaaaccacctcctcacctcctgaagccaagagttagctgtattcttctagaggcttcagtctgctccataggatcggtggtagagactgcaggggcatttttgtaaaagtttatttggaaacatttcacttacagaaaagttataaaattaaaaacagtacaaagaacacccctatatataatatctgtactcagatttacctgttacattttctccccgttgctatatcacttatgagtgtgcctgccctcccatatgtgtatacatttttcctctttctgaactacttaagggtgttacatatatcatggcctttacccccaaatatttcagtgtgcatttgctgagaatagggatacttttacataaccatcataaaatgatccacttttgtaaatttaacattgattaaaaacttttatctgatatctaccatctgtagaacattgctcattttgagtttgtctgatgtctccccatgatgagatgcaggtgaggcactctggccagaaccttcacagggcaccacatctgggggcacatgctgtttatctgctcctcctcgtgttaatttcatccgctggtcaagatgttgctccatttctctaccgtataattactgattttccccccttgcacctaataagtagtctgcaggaagacattttaaggccatgcaagtatcttgctttcatcaaaatttccctctggtgcagtctttacgatgagcttgcaaaatgataactttccaactccagcacaccctccacaattaccagtcaccactcagtcctcactcctgccgattcttttatatatacattattggtacagactcatgaagttctattttttactgatttataattcattgctgggctgcttttgatgccccaattgctgtctttgtgacatgcccccattggcatgttttgggttttttttgggttttgttttgggtttaattcctttttcaacatagcaaaatgttttgggtttgtcttgcactaccttggctggatatttgtaatatagggaaacaaataaggtgaggcgtgactaaaatgtctgcagtggacggtgcacacatgtttattgggcagttctttagctgtcctcatctagacacttctgcttctcttttcttcaccattctcaatcttcctttccagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagagttacagtttgtcatttcaatccatgcccagccacctcatttcttgttctgctttcagcaggggctcagtgtggggcaagcccctccatggccctgtaacacctaaagccctttgtctcctgaacttgcataaagatgatgggtaggcagtaaaaagctggccttggccagccctgtcttatccgctgaatcaaggtcaaactctgaaaggctacaaatgctcgggaaccccgtagcagagggtcagttttttagtttctgttgagtttttcaggatgggaaacttcttcctgctgagagctggatgggagtcctggcaggaatgtcccctccaaaagagaatgtctttagagcagggacaagaaagaccacagctgtttagtgaggataacagctccag

SEQ ID NO: 8 - DNA, 7570 bp, M. musculus
tcccgcctcctccagtctggcagcgggcgggtcccggtggcgccgccccgggatggggagcgtggtacctggctgctagtcggtgggctctgaagtctgacctgctgtcactttctccgtcgccacaagcggcccggtggcatgtgctaaggcggcttccgctgtttcagtctagatttttttcttaacagtcccattccaattcttttgcaagcaaagaaactgaggctgcccaggctctggactggaggatgacgagccccgggcgcatcatgccactcatggattacccggactgaatgacttgaggggtgaagagggtcctttttattctgatgcttctgggacgtcgaaattgccttctctggaaagacccatcccctgcctgggcttcagaggcccacatggaaacgcagtgatgatgtggtggtccactctgatgtcactcttgagggctagttctttttggaggcggatatctgctgagacaataagaattataagagctctgagagcttattttgaaagaataatggatgaaccatctccgttggccaaaactctggagctaaaccagcactcccgattcataattgggtctgtgtctgaagacaactcagaagatgagatcagtaacctggtgaagctggacctagaagagaaggagggctccctgtcaccagcctccgtcagctcagatacactttctgatttggggatctctggcttacaggatggtttggcctttcacatgagatccagcatgtctggcttgcacctagtaaaacaaggtcgagacagaaagaaaatagactcacaacgagatttcactgtggcttctccagcagaatttgttactcgttttgggggaaataaagtaattgagaaggttcttatcgccaacaatggtattgcagcagtgaaatgcatgcgatctatccgtcggtggtcttatgaaatgtttcgaaatgaacgtgcaatccgatttgttgtcatggttacacctgaagaccttaaagccaatgcagaatacattaagatggcagaccactatgttccagtgcctggaggacccaacaacaacaattacgcaaatgtggagttgattcttgatattgctaaaaggatacctgtacaagcagtgtgggctggctggggtcatgcctctgagaacccgaaactcccagaactgctcttaaaaaatggcattgctttcatgggccctccaagccaggccatgtgggctttgggggataagattgcatcttctattgtggctcaaactgcaggtatcccaactcttccctggagtggcagtggtcttcgagtggattggcaagaaaatgatttttcgaaacgtatcttaaatgttccacaggatctgtatgagaaaggctatgtgaaggatgtggatgatggtctgaaggcagctgaggaagttggctatccagtgatgatcaaggcctcagagggaggaggagggaaagggatcagaaaagttaacaatgcagatgacttccctaacctcttcagacaggttcaagctgaagttcctggatcacctatatttgtaatgagactagcaaaacaatctcgacatctggaggtccagattctggcagatcagtatggcaatgctatttctttgtttggtcgtgactgctctgtgcagcgcaggcatcagaagatcattgaagaagctcctgctgcgattgctaccccagcagtatttgaacacatggaacagtgtgcagtgaaacttgccaaaatggttggttatgtgagtgctgggactgtggaatacttgtacagccaggatggaagcttctactttttggaactgaaccctcggctacaggttgaacatccttgtacagagatggtggctgatgtcaatcttcctgcagcacagctccagattgccatggggatccctctatttaggatcaaggatattcgtatgatgtatggggtatctccttggggagatgctcccattgattttgaaaattctgctcatgttccttgcccaaggggccacgtgattgctgctcggatcaccagtgaaaacccagatgaggggtttaagcccagctctggaacagttcaggaacttaattttcgtagcaataagaacgtttggggttatttcagtgttgctgctgctggaggacttcatgaatttgctgattctcagttcgggcactgcttttcctggggagaaaacagggaggaagcaatctcaaatatggtggtggcactgaaggagctgtctattcggggtgactttcgaactacagtggaatacctcatcaaactgctggagacagaaagctttcagcttaacagaatcgacactggctggctggacagactgatcgcagagaaagtgcaggcagagcgacctgacaccatgttgggagttgtgtgtggggctctccatgtagcagatgtgagcctgaggaacagcatctctaacttccttcactccttagagaggggtcaagtccttcctgctcacacacttctgaacacagtagatgttgaacttatctatgaaggaatcaaatatgtacttaaggtgactcggcagtctcccaactcctacgtagtgataatgaatggctcgtgtgtggaagtggatgtgcatcggctgagtgatggtggcctgctcttgtcttatgacggcagcagttacaccacatacatgaaggaagaggtggacagatatcgaatcacaattggcaataaaacctgtgtgtttgagaaggaaaatgacccatctgtaatgcgctcaccgtctgctgggaagttaatccagtatattgtggaagatggcggacatgtgtttgctggccagtgctatgctgagattgaggtaatgaagatggtgatgactttaacagctgtagaatctggctgcatccattatgtcaaacgacctggagcagcacttgaccctggctgtgtgatagccaaaatgcaactggacaaccccagtaaagttcaacaggctgagcttcacacgggcagtctaccacagatccagagcacagctctcagaggcgagaagctccatcgagttttccactatgtcctggataacctggtcaatgtgatgaatggatactgccttccagaccctttcttcagcagcagggtaaaagactgggtagaaagattgatgaagactctgagagacccctccttgcctctgctagagctgcaggatatcatgaccagtgtctctggccggatccccctcaatgtggagaagtctattaagaaggaaatggctcagtatgctagcaacatcacatcagtcctgtgtcagtttcccagccagcagattgccaacatcctagatagtcatgcagctacactgaaccggaaatctgagcgggaagtcttcttcatgaacacccagagcattgtccagctggtgcagaggtaccgaagtggcatccgtggccacatgaaggctgtggtgatggatctgctgcggcagtacctgcgagtagagacacagtttcagaacggccactacgacaaatgtgtattcgcccttcgggaagagaacaaaagcgacatgaacaccgtactgaactacatcttctcccacgctcaggtcaccaaaaagaatctcctggtgacaatgcttattgatcagttatgtggccgggaccctacacttactgatgagctgctaaatatcctcacagagctaacccaactcagcaagaccaccaacgctaaagtggcgctgcgcgctcgtcaggttcttattgcttcccatttgccatcatatgagcttcgccataaccaagtagagtctatcttcctatcagccattgacatgtatggacaccagttttgcattgagaacctgcagaaactcatcctctcggaaacatctattttcgatgtcctcccaaactttttttaccacagcaaccaggtggtgaggatggcagctctggaggtgtatgttcgaagggcttacattgcctatgaactcaacagcgtacaacaccgccagcttaaggacaacacctgtgtggtggaatttcagttcatgctgcccacatcccatccaaacagagggaacatccccacgctaaacagaatgtcctttgcctccaacctcaaccactatggcatgactcatgtagctagtgtcagcgatgttctgttggacaacgccttcacgccaccttgtcagcggatgggcggaatggtctctttccggacctttgaagattttgtcaggatctttgatgaaataatgggctgcttctgtgactccccaccccaaagccccacattcccagagtctggtcatacttcgctctatgatgaagacaaggtccccagggatgaaccaatacatattctgaatgtggctatcaagactgatggcgatattgaggatgacaggcttgcagctatgttcagagagttcacccagcagaataaagctactttggttgagcatggcatccggcgacttacgttcctagttgcacaaaaggatttcagaaaacaagtcaactgtgaggtggatcagagatttcatagagaattccccaaatttttcacattccgagcaagggataagtttgaggaggaccgcatttatcgacacctggagcctgctctggctttccagttagagttgaaccggatgagaaattttgaccttactgccatcccatgtgctaatcacaagatgcacctgtaccttggggctgctaaggtggaagtaggcacagaagtgactgactacaggttctttgttcgtgcgatcatcaggcactctgatctggtcacaaaggaagcttctttcgaatatctacaaaatgaaggggaacgactgctcctggaagctatggatgaattggaagttgcttttaataatacaaatgtccgcactgactgtaaccacatcttcctcaactttgtgcccacggtcatcatggacccatcaaagattgaagaatctgtgcggagcatggtaatgcgctatggaagtcggctatggaaattgcgggtcctccaggcagaactgaaaatcaacattcgcctgacaacaactggaaaagcaattcccatccgcctcttcctgacaaacgagtctggctactacttggacatcagcctgtataaggaagtgactgactccaggacagcacagatcatgtttcaggcatatggagacaagcagggaccactgcatggaatgttaattaatactccatatgtgaccaaagaccttcttcaatcaaagaggttccaggcacagtccttaggaacaacatatatatatgatatcccagagatgtttcggcagtcactcatcaaactctgggagtccatgtccacccaagcatttcttccttcgcctcctttgccttccgacatcctgacgtatactgaactggtgttggatgatcaaggccagctggtccatatgaacagacttccaggaggaaatgagattggcatggtagcctggaaaatgagccttaaaagccctgaatatccagatggccgagatatcattgtcatcggcaatgacattacatatcggatcggttcctttgggcctcaggaggatttgctgtttctcagagcttctgaacttgccagagcagaaggcatcccacgcatctacgtggcagcgaacagtggagctagaattggacttgcagaagaaatacgccatatgttccatgtggcctgggtagatcctgaagatccctacaagggatacaagtatttatatctgacaccccaggattataagagagtcagtgccctcaattctgtccactgtgaacatgtggaggatgaaggggaatccaggtacaagataacagatattatcgggaaagaagaaggacttggagcagagaaccttcggggttctggaatgattgctggggaatcctcattggcttacgatgaggtcatcaccatcagcctggttacatgccgggccattggtattggggcttaccttgtccggctgggacaaagaaccatccaggttgagaattctcacttaattctgacaggagcaggtgccctcaacaaagtccttggtcgggaagtatacacctccaacaaccagcttgggggcatccagattatgcacaacaatggggttacccactccactgtttgtgatgactttgagggagtcttcacagtcttacactggctgtcatacatgccgaagagcgtacacagttcagttcctctcctgaattccaaggatcctatagatagaatcatcgagtttgttcccacaaaggccccatatgatcctcggtggatgctagcaggccgtcctcacccaacccagaaaggccaatggttgagtgggttttttgactatggatctttctcagaaatcatgcagccctgggcacagaccgtggtagttggcagagccaggttagggggaatacccgtgggagtagttgctgtagaaacccgaacagtggaactcagtatcccagctgatcctgcgaacctggattctgaagccaagataatccagcaggccggccaggtttggttcccagactctgcatttaagacctatcaagctatcaaggactttaaccgtgaagggctacctctaatggtctttgccaactggagaggtttctctggtgggatgaaagatatgtatgaccaagtgctcaagtttggcgcttacattgtggatggcttgcgggaatgttcccagcctgtaatggtttacatcccgccccaggctgagcttcggggtggttcttgggttgtgatcgaccccaccatcaaccctcggcacatggagatgtacgctgaccgagaaagcaggggatctgttctggagccagaagggacagtagaaatcaaattccgtaaaaaggatctggtgaaaaccatgcgtcgggtagatccagtttacatccgcttggctgagcgattgggcaccccagagctaagccccactgagcggaaggagctggagagcaagttgaaggagcgggaggagttcctaattcccatttaccatcaggtagctgtgcagtttgctgacttgcacgacacaccaggccggatgcaggagaagggtgtcattaacgatatcttggattggaaaacatcccgcaccttcttctactggaggctgaggcgcctcctgctggaggacctggtcaagaagaaaatccacaatgccaaccctgagctgactgacggccagatccaggccatgttgagacgctggtttgtagaagttgaaggcacagtgaaggcttacgtctgggacaataataaggacctggtggagtggctggagaagcaactgacagaggaagatggcgtccgctctgtgatagaggagaacatcaaatacatcagcagggactatgtcctgaagcagatccgcagcttggtccaggccaacccagaagtcgccatggactccatcgtccacatgacccagcacatctcacccacccagcgagcagaagttgtaaggatcctctccactatggattccccttccacgtag

SEQ ID NO: 9 - DNA, 7377 bp, H. sapiens
atggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctga

SEQ ID NO: 10 - DNA, 3759 bp, H. sapiens
agcggagacaatgccacccaagccattgggaagagtcatgagataaggcacatgtagcattttagacagtgcctggcacaaaggaagttgttgactgatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactcccctagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccgctgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttgggggggttcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagggtgcctggggacctggagagatgtgtcttggtggaagataagggccatgttgcccatgcacattggggaaggatcagtgtgactacatgtatgaccaggtgctgaagtttggagcctacatcgtggacggccttaggcaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccacccagccactcccgggaccacggcaaaaggaaccacccagacccaccacccgtacaccctcagcagaccctgaagacttgcttttaaacaaagaaaatcctgggcacttctgcagggctactggttccgagctgacacccgtcttaataaaaggcccaggagtgcctcttccaaacaaaaaaaaaaaaaaaa

SEQ ID NO: 11 - skipped

SEQ ID NO: 12 - DNA, 7452 bp, H. sapiens
atggtcttgcttctttgtctatcttgtctgattttctcctgtctgaccttttcctggttaaaaatctgggagaaaatgacggactccaagccgatcaccaagagtaaatcagaagcaaacctcatcccgagccaggagccctttccagcctctgataactcaggggagacaccgcagagaaatggggagggccacactctgcacaaagacacccagccaggccgagcccagcctcccacaaaggcccaaagatccggtcggcggagaaactccctaccaccctcccgccagaagcccccaagaaaccccctttcttccagtgacgcagcaccctccccagagcttcaagccaacgggactgggacacaaggtctggaggccacagataccaatggcctgtcctcctcagccaggccccagggcagcaagctggtcccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgctgtgaagtgcatgcgctccatccgcaggtgggcctatgagatgttccgcaacgagcgggccatccggtttgttcgcatggtgacccccgaggaccttaaggccaacgcagagtacatcaagatggcggatcattacgggcccgccccaggagggcccaataacaacaactatgccaacgtggagctgattgtggacattgccaagagaatcccgttgcaggcggtgtgggctggctggggccatgctttagaaaaccctaaacttccggagctgctgtgcaagaatggagttgctttcttaggccctcccaggttgaggccaatggtgggtctaggagataagatcgcctccaccgttgtcgcccagacgctacaggtcccaaccctgcccaggagtggaagcgccctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccgggaaactgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgcgccgctggccatattcgagttcatggagcagtgtgccattcgcctggccaagaccgtgggctatgtgagtgcagggacagtggaatacctctatagtcaggatggtagcttccacttcttggagctgaatcctcgcttgcaggtggaacatccctgcacagaaatgattgctgacgttaatctgccggccgcccagctacagatcgccatgggtgccccactgcaccggctgaaagatatccggcttctgtatggagagtcaccctggggagactccccaatttcttttgaaaactcagctcatctcccctgcccccgaggccacgtcattgccaccagaatcaccagcgaaaacccagacgagggttttaagccgagctccgggactgtccaggaactgaatttccggagcagcaagaacgtctggggttacttcacggtggccgctactggaggcctgcacgagtttgcgatttcccagtttgggcactgcttctcctggggagagaaccggaaagaggccatttcgaacatggtggtggctttgaaggaactgtccctccgaggcgactttaggactaccgtggaatacctcattaacctcctggagaccgagagcttccagaacaactacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgtaccatcggcaataagacgtgtgtttttgagaaggagaacgatcctacagtcctgagatccccctcggctgggaagctgacacagatcacagtggaggatgggggccacgttgaggctgggagacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgacctcggaaagaaactgcacagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggtcatatgaaaacagtggtgatcgatctcttgagaagatacttgcgtgttgagaccattttcggcaaggcaagagatgctgatgccaactccagtgggatggtggggggcgtgaggagcctgagctttacctctgtgtgggtggttttgtctcccccagcccactacgacaagtgtgtgataaacctcagggaacagttcaagccagacatgtcccaggtgctggactgcatcttctcccacgcacaggtgaccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacacgacagagctcttcatggacagcggcttctccccactgtgccagcgcatgggagccatggtagccttcaggagattcgaggacttcaccagaaattttgatgaagtcatctcttgcttcgccaacgtgccgaaagacccccccctcttcagcgaggcccgcacctccctatactccgaggatgactgcaagagcctcagagaagagcccatccacattctgaatgtgtccatccagtgtgcggaccacctggaggatgaggcactggtgccgattttacgtacattcgtacagtccaagaaaaatatccttgtggattatggactccgacgaatcccattcttgattgcccaagagaaagaatttcccaagtttttcacattcagagcaagagatgagtttgcagaagatcgcatttaccgtcacttggaacctgccctggctttccagctggaactcaaccggatgcgtaacttcgatctgaccgccgtgccctgtgccaaccacaagatgcacctttacctgggtgctgccaaggtggaaggaaggtatgaagtgacggaccataggttcttcatccgtgccatcatcaggcactctgacctgatcacaaaggaagcctccttcgaatacctgcagaacgagggtgagcggctgctcctggaggccatggacgagctggaggtggcgttcaataacaccaacgtgcgcaccgactgcaaccacatcttcctcaacttcgtgcccactgtcatcatggaccccaacaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagaggcgattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcgggagctccggggaggctcctgggtggtcatagatgccaccatcaacccgctgtgcatagaaatgtatgcagacaaagagagcaggggtggtgttctggaaccagaggggacagtggagattaagttccgaaaggaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctga

SEQ ID NO: 13 - DNA, 127757 bp, H. sapiens
caaacagaaaccctacactctgtagccatcatccccatcccactaggtcctggcaaccactaatctgttttctgtctctcaagattggcctgttctgcacacttcatatacttggaatcgtataatatgtgaccttttgtgattggcttctttaacttagcagttttcaaggttcttccttgaaccttggcaggaaactaagatccagaggggtgaaggaatatgtccaagcctgtttcaggcagagcagggaggagaaccccatctctcccctcgtccagtatttcaggaatacacagcaccccaacagcctcctgccccactagcttctttaggagagaaatcacttgattatgtaaatcctaaaatgtctctccttttctccttacagattttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggtaatgtgcattttctccttgtaactgaggagtgcagagttcaggtggggtccacacccttcccaacctgtgcccaccttgatcaagctgtttgctgatgccaaagcttcaagggtggctatgcacaaaaggagaagacacgagccttctcagaagtttccttccttccttccttccttccttccttccttccttccatccttccttccttctttccttccttccttccttccttccttccttccttccttccttccttccttccttccttccttccttccttccttccttccctcctttcaaaatcattccttgaggctgggcacagtggctcatgcctgtaatcccagcactttgggaggccaaggcaggcagatcacttgaggtcgggagtttaagactagcctggccaacatggtgaaactccgtttctactaaaaatacaaaaattcaccaggcatgcaggcgtgtgcctgtaatcccagctgcttggaaggctgaggcgggagaatctcttgaacccaggaagtggaggttgcagtgagctgagatcacgtcactgcactccagcctgggtgacagggcgagaccttgtctcaaaaaaggaaaaaaggaaagaaatcattccttgtgcatctactgcatgcacagggctcgatgccatgaaactgactttctagaagacctcagcctagttggggaagatgaccttgtgtttagttataatttaagctgaatgagccaaggctggcaagagccacaagtgatgatggtagtctagagggaggggcagttctctctgcctcctgaagagacattgattcattcattcttttttttttttttttttttttttgagacagggtcttactctgtcactctgttagctgagtgtactggtaggatcatagctcactacaacctcaaactcccgggctcaagcaatcctcccacctcagtgcactcctgggtagctgggactacaggtgtgcaccaccacacctagctaatttttaaattttttatagaaatgggaatctcaccatattgcccaggctggtctccaactcctggactcaagcgatcctcggtctcccaaagtgctgggattacaggcatgagccaccacacccagcccattcattcattcattcattcagcaggtaactgacaactgaaaaaccagccttcccccagtgatgcctgaaaagcagaaactcaaacactctaaaggtctccatcaatttgattgttggaaatgaatgcctgtaggttcataacaggtgggactatcccagcggctgcagtcagtggctttgttgttgatgttgttgttatccaccttctcctctgccatccccaaattacaaatggaatacagcacttccaggtagaaaatttgggaaatataggagaacagagagaagaaaagagccaccaaccaaaacttcaccagccagagggaaacctctgttctcattgttctacttcttccttctagtgtgtttttctcctctggagtgaagttttactggctattcttttaagcatctcctgtactctctcccaaattagaaaaatctagaggtggtcttccatacatgtccatgttagcagtgagcttggttttaaccctggtagctggaagtagaagacagagaaaaaggaggaggaaagtattccatatactgaaacttttcaggggaagagtgtttgagtttctagaagggttaagggaagagaaagtctcagaatctagtacaaagagcacagtctgtggagtcagctggagtggggttcagtctttggctctgccaccccctactgtgtgaccttgggcatgacccttcacctctccaggccccagtacctctgtaaaatgtggaagggattaaatgggataatgtaggcaggcatggtggctcacacctgtaattccagcactttgggaggatgaggcaggaggatcgcttgaggccaggagttcaagaccagcctgggcaatatagtgagacctcatctctaaaaaaaaaattaagaatttgccagacattgtggtgcatacctatagttctagctacttgagaggctgaagcaggagggtcacttgagcccagaagtttgtggttatagtgagctataattgtgccactgcactccagcctgggcaacagagcaagactctgtctcaaaataaaaaaacaaaaaagaatgtatcaaaccaacaaacttataacatgattattattattactatttcctgagtcttggatgccaaaatagtcgtgaagattaaatgaactaatatttctcaggtacttggcaagagaataaagcatccatatttggtagataataaatagaaaggggggcaagtctcccacctttccacccactgtcttcctgccaccattttgaggggtctttactggtttgagcttaaaccaaggtttttctgagctggtacatttataaaggcgaaaactatctctctctttctctttctttcttctttttttatttttttggacagagtctcactctgtcacccaggctggagtgcagtggcatgatcttggctcacagcaacctctgcctcccgggttcaagcaattctcctgcttcagcctcccaagtagctggaattatgggcgtgtgccaccacacctggctaatttttgtatttttagtagagacggggtttcaccatgttggccagtctggtcttgaactcctgacctcaagtgatccacccgccttggcctcccaaagtgctggaattacaggcatgagccatcacgtctagcctacttaactatctttcatagggaaaatgaaaccaaaatgttgagtgaatttcctgccctcgtgtcttcatggcatagaaacctaacattgtagatcaatcttttatccttactttgtcccagcaaacagctggcaggagggacagagggatcttggaaaggcagtgaatgtggagctgaatgacattgtaggattgtgggcgattcaaaggctatgatatggtgaacgaaggagtgatgtgctgcatgaacttgggtgagtcccttcccctctctgagtctccaatttatcatctttagaatgaggaggctgaggctgggcctgatggctcatacctgtaattccagcactttgggtggccgaggtgggtggattgcttgagctcaggagttcaagaccagcctgggcaacatggcaaaacctcatctctacaaaaaaatataaaaattagccagttgtggtggtatgcacctatagtcccagctactagggaggctgaggtgggagaatcacttaagcccaggaggcagaggttgcagtgagctgagattgccccactgcatcccagcctgggtgacacaggcagaccctgtctcaaaaaaaaaaaaaaaaaaaaaatgaatgaggaggctgcaccagactcctgagatgtgacctgtggccctaaagctcactgacatacagttagttattttgtccccggtatgtgtgcattttcagagttgagaatttagaattttagcacccaggggcaatgcgggtggttctgctggcacctcctgagacactggcacttcctcaaggaacattcccagccccagaatcaggggcttctgacagagaagactcatgtgtgcttgttgtttctaatgaactgtagtgagaatcccacatcaaagaatcttcagggagtcaagccttagacatgtgtgctggtgcctgctgcctctggtgtttgactggatgaaaaaattatgtccaaacctggtgttccagcctgttggaaacaacgcatatcaaaatgaggctgaggtccagcatggtgactcacgcgtttggggagactgaggtgggaggatcccttgagcccagaagtttgagagcagcctgggcaacataatgagaccctgtctctacaaaaaataaaaataaaaaataaaatgaggccaggtaaggtggctcacacctgtaatcctagtactttgggaggctgaggtgggtggattgcctgagctcaggagttcaagaccagcctgggcaacatggtgaaaccccatctctattaaactacaaaaaattagccaggcatggtggtgcacgcctgtagtcccagctactcaggaggctgaagtgggagaatcgcctgaactcaggaggtggaggttgcagtgagctgagatcacgccactacactccagcatgggcaacagagtgagactctgtctcaataaataaataaataaataaaatgaggctgagcattttattatcttgtagagcttttggctttggattttggcatctttgggatccgtggtagcctggtgtttgctggttacccattgactcttttgcacacatacaggcagggtagtaatacctcttccctggtgttcacaggtcaacacccaagcagttttgggtgtaggccatggaaggtggtgtcaaaagacaaaatcacagcaaatttgatttaaaactcgaattggcttttatttacaattctaggatcatgcagcacctcattctgtaaaatagaatgggtcttccgaagagctgagcagagaggagcttggctttataggcagaacagggctgaagaaagcagaaacaagggacaaaggggagcttcatagtttctttctttttctttttctttctttctttcttttttttttttttttttgagacagagtcttgctctgtcacccaggctggaggctggagtgcaatggcacaatctcggctcactgcaacctctgcctcccgggttcaagtgattcttctgcttcagcctcctgagtatctgggactacaggcacatgccaccatgcctggctaattttttatatttttagtagagatggggtttcaccatattagctaggctggtctccatctcctgacgtcgtgatccacctgtctaggcctcccaaagtgctgggattacaggcgtgagccactgcgcccggcccgcttcatagtttcaaaatgactttcccttcagggttaaaacaaatgcaactttcttatcatgttggctcaggtacactggaccccttctgattggttgctattgttttttggaaaactggtcagtttcaaagttcagactgattgcgaggcagttggccaggagtgatccgtcgttttggtttggtctgtaggggctaagcacaggagctcagctcaaaatcatggcctcccatatattaaaattttgttttaattttttagatttggggggtacaagttcagttttgtcacttggatataattcccagtggtgaagcctgggcttttacgagccattgcttgcatagtgtacattgtatctattaggtaatttgtcattccttaccccttcccaccatgccacctttccaaatctccagtatctattattctactctttaggtccatgtgtacactttatttagctccacttataagtgagaacaagcataaattatatttaagggtggtgcatgcaggccagccagccagttgcctgtaaccagctggagcactgaggaaaggaagcctgacccaaaaaggcaaatacagtgagcaagaatccctgttagctgaatccaggaactccttctgaaaaaaaatattatttttcttgaggccaggcacggcaggtcatgcctgtaatcccagcactttgggaggccgaggggggcggatcacaaggtcaggagtttgagaccagcctggccaacacggcaaaaccccatctctactaaaaaaaaaaaaaaatagaaaaattagctgggcgtggtggcaggtgcctgtaatcccagctcttcaggaggctgagttaggagaatcacttgaacctgggaggcagaggttgcagtgagccaagaccacgccactgcactccagcctgggcaacagagtgagactctgactcgaaaaaaaaattattattattttttcttgataagttgctaaataatctgtatcctctggcaaatcttctaaccgtttgaggtcctgtttctgcaaaatggaagcaggggctagaggtttaagctagtccttccagacaggatccaacccttgccccatttccaagacaaacaactaaggcctgggagaagaggccaggggtatttatttgagggttctgactcacgtggaagccacagtgaagaagtgacttgtatttgtggatctgcttctgctctctgcagtttccttgggcagtcacttcactgctgctctgccctggaaggccacttcctacattcacctcttcctgccaggccagtagctgggagactggcaaggcaaggatggaaaatgcttgtgttaagtctgtgatttgggaggaagctctttctgaagcagtcttcaaggggctgtctccttcctgcagtgcccagagcatcccagagttctcacaactgtgttcctgttttgggagttcgcactgggttccctctgaactgaaacactctctttctcccaacccctgaacccagacctcccaccagggccagcttcacaggcatgccctgtgcttcaagggaccccgtgcttgttttgacgctttgttgtcgccgtcttgagattcttttttattttgttttttgagacatgatcttgctctgatacccaggctggagtgcagtagcatggtcatggctcactgcagctttgacttcctgggctcaagtgatcctcccgtctcagcctcctgactagctgggactacaggcacgtgccaccacagctggctaatttttttatttttggtaaagatgaggttttgccattttgctcaggctggtcggaatctcatgagctcaagcaatctgcccacctcggcctcccaaagtactgggattacaggaataagccactgcacccagccccaaattcacaataatttttcaacaaggggctctgtgttttcattttgcactgggtcctgcaaattctgtagccggtcctgcctctactgctagctctttgcccatcagagtcacttcctcaaagggccttccctgtccctttctcacatttaaaaaatctaccccccaattaccttcagtatctttatcaatcactctgattagttgtctttgcaacatttaattatttcttgagattatgtctgtttttgtttgtttgtttgtttgtttgttttgacacagtttcactctgtcacccaggctggagtgctgtggtgtgatctcagctcactgcaaccccacaggctcaagaaatcctcccacatcagcctcctgagaagctgggactacaggcatgcatcaccatgtctggctacttttttttttttttttttttttttagtatttttagtagacactgggtttcaccatgttggctaggctggtcttgaactcctgagttcaagcaatccacccacctcggcctcccaaagtgctgggattacaggtgtgaacctccacaaccggctcctaaaagattacgtcttttatttttttatgatctacttggttattacctgtctccctacactggaagcaagttccgtgaagccagggccatagttatagtggtctctgtttttccccactgcctaggctggtgctggctcatggtaggctttgaatatctgctaaatacatgaatgaaatgagctgcaacaagcttgccaaagacagaattctgcattacgggggaatgtaaaacatgtgatgaatgagtgtgggaatggatgaacgaatggatgaatgaatggatgaatgaatgaatggattaattaattaattaacaggtgaataggcattttatagttgttgctctttagcagcagtaaatttttgttttcataaaattctttctccttgtatcttgtgactttggagactagttctggggtgaaactccaattttaaatttttcttctgtctttgataggatcatgcaaactcagcctttctctcctttctcccagctggcaagggctggctgagaatatgaatccaacaacctcgttaagctctctcctcccatctcctcccctttgggttgatctcagggcagggattagaacttggcctttccttggacttggaaacagtccctgaggtttggaaatcccatgcaacacttagaaacagagctaatgagaacattacatgatgtggcaaaatcactgcttacatgctctgaaatgagcacggttacaagaacctcctgttctgtgtgatcccattttgttggacaaacagcatgtggttagtagtgcatagtgggcctatgatgagacactcaggttcaaagctacctcttcctagcttgtaccccgacttagtatgaccctgtggggtgcgcatgtggactgaatggaatgggacaggttcaggattgctgagattgcagctggaatcctgaaacttaaagctatgaaattgaagttcataaattagtggtgaactcatttggcagcaaaacctgtcctgaattgatgtgaggttatgtatagtaattatttatcctattctgctgctgaaatattaatatgataatgtggaacagaaagttttaccttcctaaaaacaataatttccaagttccaaaacatatcaggccctgggaatttcagataagggattatggactatatataacatgcttagaatagttcctggcatatagtaagcacaaaaaatgcttctgcttagtaaatgtgcctaataaatgtgtgtgtgtgtatgcgtatgtgtttgtatgtgtgtgtcttagagggactgtaaagagtgtctccaaatagtaaataatcattttatgtggtatgattatgagtgatttaaattttcttctgcattttctaactttctgctctaaatgtcattttataatgcattttaacaatgtataataataaaacagtataaaaatattgggagaaagagtaaaccaatcatctcacttcctagataggaagctgaagcccagagacattccaggcctctcagcaaggtaatcagaggcccagagcaccatttgaacccagaccctcgttagatgtggatgtgaaatcagtcaacgaactgctagtattagtgtcactgcctaaccttcccccagcgggtaagaggcttggactccaggacgggcacctccgtcctcctcctaacttgttctttctattagtgggaagggttgggagattagggtagtttatggataacctttaagtcgtatgagcttgaggacatcatctaccttctcaggggccagactggacactctgaggttctttgtggctctaacagttggtggctttgttcctttatatgtggaggaatggacagcagggagggggctgggagatagagaaggagagtagctggaaaatggcagaaaagtttgttaatttacaggcaggctgaagcgggaggatcgtttgagcccaggagtttgaggctgcagtgagctatgattgtgccagtgtaccccagcctgagcaacagagcaagaccctatctctcttaaggaaattgttaatttagaaccattttctccctggtaaatgaccacagatagtctgggttctaggcaagagagaggacacactaagggatgaaatggtaggtggggaagtcaaggtttgtcccatccattcgttggcccaggagcagttattgcaacccctctgggtgccaggcagtcagttggcactacagatgcaaagatggtgagatacagcctctgtccttagggagaccagggcaaggggtctgagagcccacaggccagggcattccccatcatttttacagagagagctgtggaatagttaagagcacaacacgctggtggctgaggctgggggctggtgtgctggcttctccacctagccatcatgtgacttggggccaagttctgtgattttctgtgcctcagtttcctctgaaatgaagtcatcgtgttacctccctcacagggttgggatcaggcttcattgagttgctgtaagtacagcactcgaagcagcacccatggtgcgatcatggtcattagatccagtgcacggcataagagcccaggacccacaatcaggtctggattcagacctctcctgttacctgtctgagctgcaatttcctgctctgttgaggcaggataatactagtgcctactttaggagattgttgagatcgagtgggagcaagtgctgggggtggacggcccagaggtggttcagtagccattagttgggtgggcttcttccaaagttcttgcctgtgcgcatggttattcccaagccctggccgggcttacatcttaaaggtgtagcaacctgtgtccacggaggaggaagaggattgaaaaggcaggtgaagtgtcccgataaaaggataaagtccaaaacagcagatgggtgctgaagtgttccttcccgccaccatttacgaccatgttgggatcactgaggtaagaacagtttagcaaggcagaccttggatcccaggaaggcaaatgaggctctgtggggtctggacatacagagggggccctgcaggcaaaggtaggtgaaggaataccaggaaagggagctgacaccagggacctggcatcgcccccactttcccagatagcagactgggtgggcttgcagtgcagcctcccagctgcttgttcgtcatcccagcccacatctcttatcggctccaagcaaggaacaggtcaggaaactaaattgtctatgcatatttttatgcgcccctgagtgaaatgccaaggatcttcctgtaatgtttaatttattcatttattgacttaggaaggggctgggagaaactctcttttcaagtctctttagctcctaaaatgtttactttttctttttctttttctttttttcttttcttttcttttttctttcttttttttttttttgagacggagtctcgctctgtagctcaggctggagtgcagtggcacaatttcagctcactgcaacctctaccgcccgggtcccggttcaagcaattctcctgcctcagcctcccgagtagctgggattacaggcatgcaccaccatgcccagctaatttttgtatttttaatagagacagggtttcaccatgttgtccaggctggtcttgaactcctgacctcatgatctgccctccttggcctcccaaagtgctgggattacaggtgtgagccactgcgcccggcctcctaaaatgttttctaggagcttgggggaaagaggatccctgtctttgagttgttcttgtattaagttaatacaaggtacagagcaactaaccattcatacattcccctcccccttaagcatcattgccctattttagaaaaattattcacttctgctctatacttaatgtaacacagtcccccccaccccatatattgaaagagattatttcattttgcttttctgcaaaaatgaaggcaaattgtatgtggataattttatagttgaggaagtggagagacgggatttacttaaggtcatccgtgaggggaagggtaagttcaagcccatggatggcacagtctttctaccacgctgctggccacatgcatgcggattttcttgttgattttgtgtgtgtattgttcattgacctgggttttccctctgcaataccagtaagtaaaattgagcttctagtaagtctgagaggaagggcttaatgcatgagacagcaactaccaccatgcttgaactgtttcatcaaaaagcacaacaatggatgtttgtataaaggtggtgttgtgcttggaggtggatattaggttggtgcaaaagtaatcgtggtttttgcaatcccttttaatggcagaaactgcaattagttttgcaccgactgaatattattcatttctttccgtcttctattccctaataatgcaattagagaaaaatgcaaggtcatgatcactgtgatgaaatgatgagcccacccatctaaatgaaatcccttatttgagaccctgggtcatagtgagatgtgtgaggctgtctttcaggctgtattagcagagaagtgagaatatctatacagtgtttaagtagtgttggggtttttgcaatagagaataaaaatctagagcaatacaagtatgctggcaagcagttctcttctgcatgatcctaactgactttggtagggttggggtattttgaaatatcttcatttcttgattttcattgctttccctattttgaggtggttacatttacactggggatatttgggggatgaatacttgttggttttggtttgaatctctaaaaatcaggatacagtgggttacttttttggaggaggtgaagacaaggctgtgaacaccttcccagaaacttgaagaactgagaattttgtttatctgttttttttcttaaacctgttgttgaaatgttatttaatatatggtcagggcatagctatccactgctgtcaggcatggctgcttaaacaggggcccagggtgtttatgttgtggccaagtacttggcacccccgggaagtgtggccctgcctgtgccttttctttctttctttctttttttttttttttttttttttttgagaaagggtcttgctctattccccaggctggagtgtagcgagatcatggctcactgcagcctcagctacctgggctcaggtaatcttcccgcctcagcctcctgagtagctggaattacaggtatgcaccaccacgctggctaattttcatatttttagtagagatggggtttcactatgttggtcaggttggtcttgaactgctggcctcaagtgatctgcctgcctcggcctcccaaagtgctgggattacaggtgtgagccactgcacgtggccttcctgtgaagtgaatttttaattgtattttaaaatttgttttcatgtttttgtttgttttgagacagagtcttgcaatgttgcccaggctggaatgcagtggcctgatctcggctcacttaaacctctgcctcgtgggttcaagtgattctcctgcctcagcctctggagtagctgggacttcaggccaccccgccaccacacccagctaatttttgtagttttagtagagacgaaatttcaccatgttggccaggctggtcttgaactcctgacctcaagtgatctgcccacctcggccccccaaagtgctgggattacaggcatgagccaccatgcctggcctgttttcatgattctgatacattatatttttacacatttataggatacatgtaaaattttgttacatgcatagaatgcataatgattgtagggaccaagggaatatcttctgctttgccctctgaagtttcgctgaaaaattaacttgtaaaaaggcagattagttggagaaaagacacacaaatttaattaatgtgtacactgggagaaccgcagagtgattacccagaagggaatttactggccagcatttacattatttttggttggtttgttggctatgaaagtaggctacctttattattactgcgatgacttctaggtagtgttttggttctttgcatttattacattacttgaagaagcattcattcatttatttttgattttttgagatggagtctcactctgtcactcaggctggaatgcagtaccgccatctgggctcacttcaacctccgcctctcgggttttagtgattctctctcctcagtctctcgagtagctgggactacaggtgtgcaccaccatgcccggctaatttttgtattattagtagagacagggtgtcaccatgttggccaggccggcctcaaactcctgacctcaagcgcctgcctcagcctcccaaagtgctggtattacaggcatgagctaccaggcccggcctcattcgtttattctaactggaatcggtttgtctgagttcaagaccctgggctctggcacttcagataacatgcatctctgggccccagtttccttatctgtattatagggataaaaacaataagattgccacgaggattaagtgacacagaggaacaaaggagcacttagtaaatgttagtcttaccagaagtttatttcggatcaccgggctgctggggtcctccctgtcctggaggcactcgcttcagtagcggacccaggtggtgcaaagtgcgtgctagaagcacactgggtgattgcgcagccacctgtcccagggagtggaggtgaaaagatgagagaaaccaggactttgggaaataaaagtcgacttgacaacagggacttttaacgggcacagtggcgacctctgactcacattttaaatttcccatattttccaccgcttccctatcgtgtgtgtattcaagcatatcaattgctgccaatatgtaggggtgtcccatattggggagcaaagcagaagagaggctttaaaaatatatatctccgcagctcatttcggctgccgaagctcagcggcgggtcggaggtaggccggcccgggggcggggctccgtccggaaggcggggccctcctggggcggggtcggtgtgggggcggggcctgggtggggcctaggcgggcgcgatggcccgggactctggcgcgcagggtgcatttcgggatggagcaagcgcagcgcgaagttgggcgcccgccggctgcagcagaaccccgcccgcggcgctctaggactgcatctcggcctccgggtcgcgacctggctgtcctgctgggtcccgggcctcgggtcggcttcaggcggttaaggggtgcatgctctgcacccctgcgggagcccggtgggattggcctgcggggtggtcaacatgagtcctgccaagtgcaagatctgtttccctgatcgcgaagtaaagtaagtaagcctgcaattgtaatgaccatgatcttttacaaacttacgcagtcttccttccccttgaagtcaagctgtgtgtcctcttagcaccgccccctttacccccacccccatccaaagaaacacgggcttgagttggctgctggggagatgatgcccgccttggaaactctagctggccttggcgggaggggaggaaggaggctggacgttgggggtgacgttgcttggaggaggtcgcttcggagcacacaggtgcctaaagatcagcccttgcgcaggggcacgccttccccgctttctctccttcgcctccagaagctgatggttgtggaaggcaggtctcttttgaagctgaagcctgggcaaatcgacgtgaacttgagcaggctctcattgagggtcattttctgagcagatgagcgtaggcatctcagtgcctgagtgctttgtagctctacctacttggttttgtttctttccttttttgtcctcattttattgcacttaaaaagaattaccaaattgatggtgtgtctgttgttgacaattcagaaaattatagataagcaaaaaagaggaacaaaaatcacccataattccacccctgtgatgtttgttaacagttgtatattcttcagcttttttttttttccggtgcagatatgttttaatttataaacttgaatcatgcagaacgttctgtaactcactttttcattcaacattaagtatttttctaccactgggcttggcaaactatgacccactgcctgttttgggatggcctgcaagcagagaatggttttttcatgtttaagtgattgaaaaaaaaatcaaaagaagattgttttgtgacacgtgaaaattacatgaaattcaaatttcagtgtctacgaaaaaagttttattggactgcagcctgctcatcgatttatgatttatgcctagttcatggctgcttttgtgcctcactggaggatttgagtggtgggacagagactgaccagatctaaagtacttactgcctgacccttgacagacaatgtttgccaatccctgcctacaacatgcttttactggattcatagtgttcctttaaatgggtgcaccttaaaatgtatgaataatcctcgccaggcagggtggtgcaagcctgtagtcccaaatactcaggaggctgaggagggaggatgcttttgcccaggagttggaggctgcagtgtgctatgatcgttcctgtgaacagccactgcactctagcctgggcaacatagcaagaccccatctctgaaaaaaaatgtgcccaggtgtggtggctcatgcctgtaatcctagcgctttgggaggccaaggcaggagaactgcttgaactcgggagttcgagaccagcttgggcaacatagtgagacccccatctctacttaaaaaaaaattagctgaggatggtgatgcatgcctggagtttcagctactggaaagactaagggaagaggattgcttgagcctgggagatcgaggctgtagtgagcaatggttgtgctattgcactccagcctgggcaacagagcaagaccctgtctcttaaaaaaaaagtataagtaatcccctataagtagcggatattcaggctgtttctctctgtttttttttttttttttgggggggggctattatcaacagcacagtgaggaatacccctgtagctgaatctctgcctccatcctttattttcttaggatatgtttacctggtccataaacattcatgcacacctcccatgcataaggcctgcaactggtagcaggaagggtcgcaaaaatggttggaaaccgtgacctccgccctccaggaacttcggttccattgtggaaggcagatgtcttctcagtaactccaattcgaggctgatgggtgcaacagtaatagccactaccactcatggggtgctttcagtatgccaggccaagtgctttgtaggtgtggtctcatgccatcttcaaaataccactgtgggggcactaagtggagagtgttgtacccatttcacaaaccactttaatggaaaaaaagaaaaacctcacacaaatttggaattgtcccagcaagtccaggacgtggggtccccctatttataataatatggacatactttgttgggggactacattgttcctctcttagcttagagtggctaaaaagatggatttggacgatctaactttgccaccaagctgtgtgatcttctggagcaggtaccatcaagccttggaacctcagtttccacatctgtccaagggactagccctcataggcctttctagagttgttattattattattattattattattacagacagggtcttgctctgttgcccagacagtggcatgatcatggctcattacagcctcagcctccgggctcaagcagtcctctcacctcagccttccaagtagtgggaccacaggcatgcgccaccacacccagctaatttttgtattttttagagagacagggtttcaccatgtttcccaggctggtcttgaactcttgagctaagcaatcctcacaactcagcttcccaaagtgctgggattacaggcatgagccaccatgcccggctctttcttggtccgttgagactctgtgtggaagtcgctggtcttgagtactgccctgggtcagcacaaacattgatgaaaactaataagtaaagacagagttcggttatgaaagagccctctggagttgggaggcatttgggatcttgtgctgaaggctcgggccatctaagaagccagaactcctgagaaggtgaggtcgcaaatgatgactgatttttcatggcatgagaacggggtcacagttcagagagtagagaaatgattgtggatcagagtgcagaagggcttgaaataaagttggggatgaggaggcagaagttgttttttaatgagtcccatttcactgccatgcaattctgctctgaaaggccagctgcctgcatgcaaatattggctgtagacctatcaggggttttcactcttggctacacattagaatttcctggtggggagatttttgaaaaatctggatgccggggaccccacctctaccccctagacatgctgatgggaccccgacatcagaatcttataaagtttttcatgtcagggttgaaaactcgtgcctagcttggggtcagcagactgctattataaacggccagacagtaaatatttttggctttgtggccatgtggtctctgttgtaactactcaactctgctgtttcctgcaccagaagccatagttatgtaattgaacaggcctggctgtgtttcaatcagacattatttatagatggggaaattcaaagttcatataatttttatgtgtcacaaaacaggattcttttgatttttttttttttttcgatgacttaaaaatgttggctgggcatggtggcttatgtctatagtcccagcactttagaagaccaagacaggagggttgcttgaggagtttgagaccagtctgggcaacatgatgaaaccccgtctctacaaaaataaaccaattagttgggcatggtggtgcacacctgcagtcccagctactcaggaggctgaggtgggaggatcacttgagcccaggagtttgaggctgcagtgaactatttttgcaccactgcactgtagtcctggcaacagagggagaccctgtctctataaaaaacaaataaggctgggtgcggtggctcacacttgtggtcccagcactttgggaggccaaggtgggcagatcgccctgaggtcaggagttcaagaccagcctggccaacatggtaaaaccctgtctctaataaaaatacaaaaattagcagagcgtggtagcacacatctgtagtcccagctactcgggaggctgaggcaggagaatcacttgaacctgagaggtggaggtagcagtgagctgagatcacaccgctgcactccagcctgggcgacagagcaagactccctttcgaaacaaacgaaacaaaacaaaaaacaatctaaaaagttaaaaccgctcttagcctgtgggagatacaaaaacaggtggccgagtggatttgacccatgggtcctagtttgcccactcacccctggcctagccaaggtagtcatcccagggggtactgatggggcaggtggcttgagaaatttccaagggtccatttctggagagcgtggttttgtgctgtttgaacgatatcaacctttactgggctacacagtgttctttcttgctttcttgtttggaagtagttgtaattacagaattgcctggctcagaatcagctcttagcagtgcgggtagccgttaccatctctattttatagaagaaaagagagggaagaaattgaaggtctgattaatgccggggccctagcctaatggcccagcctgggctcctgtaatgctatcctgcagacgtacatggtagctaaagtgttgcaagctgtttactttggctaggtccagggataaactgttaattccatcatgtgaggaaactgaggcagggagtattgaagtaactttcccaggattacacaggttataagcggtagattctggcttcaaagcctaggaggatggccgcagtctaccagagtttctaaactgcggctctgttgacacttggggctgtccagttctttgtggggctgtcctgtgcattgcagggtgttgagcagcatccctggtctccacccactagatgccagtagcgcatcccccaagttgtgacaatcaaagatgtctccaggtattgctccccggggagcaaaatttcccccagttaagcactcagggctgggcgcggtggctcacccctgtaatcccagcactttgggaggccaaggtgggcagatcacctgaggtcaggagttcgagaccagcctggccaacatagtgaaaccccatttctactaaaaatacaaaaattagccaggcatggtggcaggcacctatagtcccagctactcgggaggctgagacaggagaatcgcttgaatctgggaggcagaggttgcagtgagccgagatggtgccacttcactccagcctgggtgacagagctagactctgtctcaaaaaaaaaaaaaaaaccaaccaaccaaacaaaaaacctcagcattatacatgtttgtctcttatttgagaggaatataagaggccatatgtgtaatgcatgttttaaaagtccagttaatagaggggcttccatttatctcagattgtctttctgcctagaagttagattctgaggtcagctagagttggatttgaaacggggctctgccacttgccagctgtgaaactggaggtaaatggtcctctctgaacctcggtttcctcatcgtgaacctggagatgacagactcctccatacagggctgtggagattcactgagaggccccctgtgcccagtccatagtgggcagccgagaatgtttatttcctccattcctgatactattctgcctggtcttgtgctccggcagctgactgcatttggtgtttggctgacacctctgctgttgattgtacctgaagtcatttccaaagtcaccttgaaacatttcagctctcacccttgccgtgctgtataaggacagggcttctcactggacaatggcacttaggatgatcctccttcagtggaagcaaatgctggccgaaggtcagctctctagagccaatgttggttggcttccagctttatcaaaaagaattaaaatagccacttgcctggagattgggcctgaaacaaggccagtccggcagctttgtgtgttcgcttgcctagcctgcggtaatgggcttgtggcctgcctgatggaggggctctgtcaccagtttcgaaatcaacatggtggccaagaatggtttttttgccccctaggccacaaatgaagtttttctttgttgtgctttaggtcaaattgctagagttttaatgtttgtgtgtgtagaaatgggatgtctcagactttctgaagctgaaccatcaagccagccagtcagggaaggtcgtggacagaatgaggggtgcggctgtgtgtgggaatgtcgattagtacaacctctgtggaaaacagtttggagagttctcaaggaactaaaatagatctgccagtctctccagcaatcccactactgggtatgtacacaaaggaaaagaaatcactcagtcagattcgcttttcattgggaggatcttaacatgattggttgaaaacaataaataaaattagcaaggagtccagttgtggggtctcacgcctgtaatcccagcactttgggaggctgaggcaggcagatcacttgaggtcaggagttcaagaccactctggccaacgtgtaaaaccccgtctctactaaaaatacaaaatttagccggacatggtggcgggcacctgtaaccctagttgctcgggaggctgagggaggaaaattgcttgaacctgggaggtggaggttgcagagagccgagattatgccactgctctccagcctgggcgacagagtgagacgcagtctcagaaaaataaaataaaataaaataaagaaataattatatcaaaagacacctgtacttgtatagttatcacagcactattcacagtagcaaagatatggaatcaacctaagtgtccaccaacagatgactagatacagaaaatttggtgtatatatatatataattttttatggctcagtagtattcttttgtgtgtatgtgtgtgtgtggtgtgtgtgtgtgtgtatacctacatgtatacatgggtgttcctcttacaaaattaatagcttttttcttattgaaaataacacatcattgcagaacattttttaaaatatagcaaagagataacggctcttaatactttagcatttttttcccccagatcaggggtctgtctacaaatgatgtcccttgggttgcatctacctttttttgtaaataaatgaagttctctttttttttttttttaggtagagtttcactctgttgcccaggctggagtgcagtggtgtgatctcagctcactgcaacctctgcctcccgggttcaagtgatttttgtgcctcagcctccccagtagctgagactacaggcgtgcgccaccatgcccagctactttttgtgtttttttagttgggatggggtttcatcatgttggccaggctggtctcaaactcttgccctcaagttatctgcccatcttcgcctcccaaagtgctgggattacaggcgtgagccaccgtgcccagcgtagcattaaccttttagaagctagaaagcagatgaatgagtggtcactggcttaaggctgagtcctaatggagcagtgaggaaagttggggacccctggccatctgtaccacagaacccccaaaaggcatagtgtctggcagcaagggatgcccctggagctgaggggtaaggagggtaccaaaatgagaaggacagggtggaagactcccaggtcccctcccctgtctcctgcggcaggggctgtccacttcgaccccaacagaaggcagcagttcaaaggtacatatagagggtcttgggagaggggatcgacaggcacagttgagggcatggggcctgtatcccaaataggaagataagggtctgaataggtgctgaattcttagaacttccccgttccccccggggctccaggctgacctttactgtccaggcagaagactggaaaacttctccctggggaatctggccagcgagagagaaagacacaaagatactgactcaggggatccccaacgcactcctacctcaccctacattgagctcagggtcaaccaggtccaccacagtctcagaaattctgttctcactcatagtcacaaggttggaaccaaggcttccctgacatttgggttcagtttctttttctttttcttttttgagatggagttttgctcttgttgcccaggctggagtgtaatggcacaatctcagctcactgcaacctccgcctctcaggttcaagcgattctcctgcctcagcctcccatgtaggggggattacaggtgcacgccaccaagcccggctaattttttgtatttttagtagagatggggtttcaccatgttgtccatgctgctctcaaactcctgaactcaggtgattcacctgcctcggcctcccatagtgctgggattacaggcgtgagccactgcacccggccctgaggtccagtttctcatatgtaagtcaaggtccaaaccagtagacacaggaagcttggaagaaacagaaaccacgctggagaagagaagtttaaaaagctctcattaatatcatcgttgaggtcagacaggatgttgcactcataggaagaggatgctataacaaagggaacatttgtaggccaaaaacaggctcgtagacatcaaaaacatgatagcagaaatgaagaactccactgaatgtttagaagatgaggctgagaaaaatcaaccagcaagtagaagaagagagagaataggagaggggaaaaatgcataaaccagtaggccagtgtaggaatttcaacatccagataataggacttcgggaaaaaatagagaaaaaaagaggcaaggacatcatcaaggaagtatttgtttcttgttgttgttgttgttgtttgagatggagtctcactctattgcccaggctggagcgcagtggcacaatcttggctcactacaacatccgcctcctgggttcaagtgattctcctgcttcagcctctcaagtagctgggattacagatgcacaccaccatgcccggctaatttttgtatttttagtagagacggggtttcaccatgttggccaagctggtctctaactcctgaccttaagtgatcttcccacttcagcttccaaaagtgctgggatcacaggcgtaagccaccatgttcagcccatcaaggaagtatttgaagacaaattcccaggatggaagtttccagattgagagggcctgagagatgtgcagcctcattggtggaagcagacacatacttgagctcatcactgtgaaatcatagagttctggggacagagggacgctcctataagcatctggatatgaaaaaacaggtcacctacaaaggatcaaggatcagaattactcttgttctagcagccttggaagccacaacacaatggcacaaggcttctaaaacttgaagaaggttttccttcctgaaatttctttttgtttgagatagagtctcactctgtcgcccaggctggagtccagtggcgcgatctcggcttactgcaacctccattctctgggttcaagcaattctcctgcctcagtctcccaagtagctgggattacaggtgcacaactctgtgtctggataacttctgtatttttagtagagatggggttcaccatattggccgggctggtctcaaactcctgacctcaagtgatctacccacctcagcctcccaaagtgctaggattacaggcatgagccaccatgcctggcccttcctagcatttcacacacagccaagtggtaaggttgaatgtgagggcaggagaaaggctgaagtgcaatggtgcaatcctagctcactgcagccttgacttcctgggctcaagtgatccttctaccttagcctcctgagtagctaggactacaggcaggtgccaccatgcctagctaatttaaattttttttttttttttttgagatggagtctgaccctgttgcccagtctggagtgcagtggtgcaatctcggctcactgcaacctccacctcctgggttcaagcaattctccctcctcggctttccaaggtgctgggattacaggtgtgagccaccacgcctggccctgaatagcctttcttagaaagctacttgaggatgtcttccactgaaaccagagggtaaaccaaggaagagcaacacacaggagacaggaaacaggagattcaacatagactgaaagggagtctccagggtgatggtgataaggaagcccagtcaggaatagggcagggaaattgagggcatcattgtcatgcgccttgccattctaccatcttcttaagtggatgaaactactggaggatatgccccagcaaaacaagggagtctaccaagaaagacgagccacccattcccccaaattaggaatccaaccccaaggaaaggcaaagggaattctagggatgtcagcaaagggaagccccaaaacaatggtgatgtaggggcctagaggacagccagtacctacggaaggagaacagaggccttcaggagagatgtcaccagtggaaaaaaacagaactgatcaattatttattattattatttttaatgagatggggtcttgctacattgcccaggctggtctcgaactcctggtctcaagcagtcctcctgccttggcctcccgaagtgctgggattacaggtatgagccactgcatgtggcctgatcaattatcttatgtgtactgggaatctattaggaggagtggggtgatttagcaacaggtacaaggaacactaagtaaaggaaaaaaatcattaactccaggaaaaggcaaaaagaaaggaactaaaatctggtacactgcagctctcatatgtgaataatgatcacaaacttcatatgtgaataatgatcacaaacaagtaaaacattgaatacccagtttgctaaattacagtagacttctatggtattgaccagctggtggaggggagccgatggggtggccttgtgagataactaaattcacatctctcaggatgggaaggccatagatgctgtctcacatggatgactcacaagattgcatacacttgttgtttaggactatggagatgtgtaattgctagaaaaaatcagcatcagtttcctctggtgtggagggacagagcaggaaacctgttttgttgttaaacatttaaaaaattgttttcagttttctaaagaaattttgtgggctgggcgtggtggctcatgcctgtattttggaaggccgaggtgggaggatcacttgaagccaggagttcaagaccagcctgggcaacaaagtgagacccctgtctctacaaaaaagaaaacttaaaaacttctgaaatacaaatgtagaaaagtacatgaaagatattaataccatgtaacaagtcggaacgattagaatgtgtggacttcttccctgatcataaaactctcacccttgttataagttttttagtattattcaggttcctaaacaatgggcatgtaaagtaaaaattaacttaggattaaaaatctaaacatccaccttgggacaggtagaagaaactgctccttctagttcatgtgctggtaccttagctggcctcttaaggtgctttcagttgggtacagtggttcacgcctgtaatcccaatgctttgaaaggctttgacgtcacttgacatcaagagtttggacgagcctgggcaacatagtgagaccccatctctacaaaaatgtttaaaagtcggctgggcttggtagtgccctctgtggtcccagctacccaaggaggtcgaggctgcagcgagccacgattgcaccactgcatactagcctaggtgacagaatgagatcccgtctcaaaaaaaaaaaaaaaaaaaaaaaaaaaaccgaaggtgcttcctgcccttgagcctccttgtaaattgcttcaggggctctggagagcaagtgcaaagcaggggggctctggtgcagtttggctcctctgctccactggctttacaggtgccgagctctgagtcccaggcttcttccctcatgcacgtctgtccctcattcttattctgcaggccgagcatgtcgggactccacctggtgaagaggggacgggaacacaagaagctggacctgcacagagactttaccgtggcttctcccgctgagtttgtcacacgctttgggggggatcgggtcatcgagaaggtacagatgggtctcggcactctgggtggggtccgattggggtgcaggggcccctcctctcagctggaggtgggagattcgggttcaggctcattctgcctgctgcagagagggggtgagggccacgctcctctgagttttaatagtttaaccctcaaatagaaataatagtgaagcctctttcaaagggctattgtgaggatgaaatgaaataagacaggtaaaacacattgtactgtaaaacactcaaaaagtgttaagggtgatcacaatgacaccaaaggaataaaaaaaaaatcattcactgggctcggcacagtggctcatgcctgtaatcccagcactttgggagggtgaggtgggcagatcatttgggcccagcctgggtttgtgttcaagttcaagaccagcatggacgacatgacaaaatcctgtctctgcaaaaaaattaaaaaattagcaggatgtggtggtgtacacctgtagtcccagctactcgggaggctgaggtgggaggatcacttgaagctggaaggtcgaagctgcagtgagctgtgattgcaccactgtactccagcctgggtgacagagcaagactctgtctcaaaaaaaaaaatatatgtatgtgtatatatatatatatatatatatatatatatatttcagacaaacagccatccatccatccatccatttgatgatccattcatgtggatggcagactttgagctcctgctctgtgctggggtgtgtgccatggaaatacatagaaataccaagaggaatgatgtgctgcgggggctgcaggaggctctgcagctgtgaggtggactcggggtagcacgtggcccccagcgcaggtagatgtgcatctacagctccttccttgtcttcccatgcaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcaggtacctgggccttgaccctctcctcccatcacgctccatccttgcctgccctcgcctccttcccctgtgcctaggcaagtccatcctggactcccgatggtcaggacctctcatgagtctgtatttatttgtccttccttctttatttaattaaaatgtctgctgacatcaagaacaactcatgtgccttacaaaaatgcagatggttaacatgcagagaggaaattcgatctttgagaaatgtctgtgttctagcagattgggggctgtttctcctgcaggtgtatgtaattgtatttcaatcatttgttcattcttccgttcatttgcctaagtttattataatgaatcattctataaacaactgttggatgatttacttttttcctgaacagtcttatccttttataggccctactccccacagcagccaaagtgaccttttaaaagcataacttcttctgctgtattttctgaaggttgttaaaaacaaaaacctcagccagagcgctggctcacccctgtaatcccagcactttgggaggctaaggtgggaggattgcttgagcccttgagtttgagagcagcctgggtaacataataagaccctgtctctacaaaaaataaaaataaaaaaattaactgggtatagtggcacgcacctgtagtctcagctactcaggaagctgaggtgggaggatcgcttcagcccagggggtctaggctgcagtgagctgtgattacaccgctgcattccagcctgggaaacagactgagactctgtctcaaataaaacaacataaacctaaaagcataactcaggtccgagcacagtggctcacgcctgtaatcccagcactttgggaggccaagatgggcgaatcacttgaggccaggagttttgagatcagcctgcccaatgtggtggaaccccatctctactaaaaatacctcccaaaaatttgccgggcatggtggcaggtgcctgtagtcccagctcttcaggaggctgaggcaggagaattgcttgaatccaggaggcggaggttgcagtaggctgagatcactccactgcactgcggcctgggcgacagagtgagactgtctcaaaaaaaaaaaaaaaaaagcaaaacaaaaaccaacataagtcaggtcttcaggtctttttgtgcttctccttaaaatgcatcagaggctgtgtgctgttcccaatattagcaacctcagcaccatcccctaagccttcctgccccaagctcttcacagacatggcctcatttgttacttacagctctgttttacagatggcacagtcgaggcacagggatgtgaatttatcacttgtccagggtcacacaaccatcatgtgatgcgggtgggatgggaaccctggtctgggttcagagcatcatccagtgggtcctcccatcttggttagtctaaaattcaaaattgtcacccaggcctattaagtcccctcctggctccatcttgaacctcttgccctccatcagccgggtaccagtcaccctgacctctggtagctcctgggcctgttgcagagtcttggcacctgctggaacctctattgaaggtgcttctcccagagccctttgtgcagtggactccctccccacccagcctgtaggtctcaacatgatcatcgcatctctctcagagaacctcatttattttcttcccagcactgaccggagtctgtagttattgtgtttattttcttgtttatcttctccaacataaaagaaaaactggacaaggaccaggaagcctgtctggccgctcacttcatcatctctggaatctccccgttggccgacacttctgtgtttgataaacataggaggcaggcaggccggaaggagcagctgctctgggatttctttctgtgtttgcatataaagtgccacattgttcaatttcaggatcttagcaattctatagtacagatgtcccaacccctgtgtttggattgagtctaacttttcctagtccaaaacactgctcagtggctgttctctgactttggcctcattgatgtgtgggtttttgtttgtttgtttgttgttgctttttttctgagatggagtcttgctctacctcccgggttcaagcaattcttgtgcctcagcctcccaagtagctgggacttcaggcatgtaccaccacgactggctaatttttgtatttttagtggagatggagtttcaccatgttggccaggctagtcttgaactcctgacttcaggtgatctgcccgcctcagcctcccaaagtgctgggattacaggtgtcagccaccgcgcccagccagcgtgtgtttttttaaggacatattcctagacatggaacttctggcttaaagagcatgagtattttaaaatcaaaacattgcgttatgttcagccttaaaaaggaaggaaatcccgtcatatgttacaacacagatgaaccttgaggacgttatgctggtcacaaaaagtgaaataagccagtcacaaaaagacaaatactgcatgattccatgtagaaggggtaactagagtagtgcaattcatagagagagagaagatcgttggttgccaaggacatgagggagggagagaaagggagttgttcatgagtatagagcttcagattcataaaatgaaaaagttgtggacatctgtttcacaatataaatatacttcactattgaactgtacactcaaaaatggttaagatggtaaattttgtgtgtgtttttttttttaccataatttaaaactctgtattgtatttttgtttgtttgtttgttttttgagacagggccttgctctgtcacccaggctggagcgcagtgacatgatcacgactcattgtagcctcgaccttctaggctcaagtgatcctcctgccttggcctcccaagtagctgggactataggcatgcaccaccattcctggctactttttttggatttttttttttttttttttttgtggagacaaagtctctgtgtgttgcccaaactggtcttgaattcttggcctcaagtgatcctcctgcctctgcctcccaaagtgctgggatgtcaggcgtgcaccaccgtgcccagccctattatattatttaatggtaaaacaatattaagataaactttaaataggactttttttaaaaacccacctctaatcccagtctgttgacagattacttccttcttccttcgttcctttccaggccttccaggccttgtccagaaacatatctgtatcacataattaaaatcatatttcattttctttacattttctttcttttttttttttattagacagagtctcgttctgtcacccaggctggagtgcagtggtgtgatctcagctcactgctacctccgcctcctgggttcaagcgattctcctacctcagcctcctgagtaccttggattacaggtgcccaccaccacgcctggctaatttttgtatttttagtagagacagaatttcaccatgttgcccaggccggtttcgaactcctggcctcaggccatctgcctgcctcggcctcccaaagtgctgggattacaggcgtgagccaccacgcctggccttctctttacattttcatacatgtttgtccattgttaccatagaaatctgcatggttctgctttccatggctgtacatagtcacatcttgtaatgttctgccattgatgtcagtctgtcagcagttccttccttctccctcccatttaatttcagagtacatcaagatggcggatcattacgtccccgtcccaggagggcccaataacaacaactatgccaacgtggagctgattgtggacattgccaagagaatccccgtgcaggtagatggactggggtgcccaagtgtggcccctgagtgtgggatgatgcccctaggttctagttcaattccacagttcacaaggggtggagggtccagatcccacaaggctccaaattcctgggctgatgtaacacagaaaagagtgttcaagtgaggcgaagcacattctgtttttaaaaaaaaattttatagacaggatctcgccatgttggccaggctggtctcgaactcctgggctcaagtgatcctcctgccttggcctcccaaactgctggggttataggcgtgagttactgcacctggctgggaggcatattcttgaaggaagattgttgctcacccctttctgtgtttgcaggcggtgtgggctggctggggccatgcttcagaaaaccctaaacttccggagctgctgtgcaagaatggagttgctttcttaggtagagtgtgtccccatcagatacatgggaattggggtattgctgggacactctgctgggtctgaccctctttctcctcctgtcctgtaaagcggaggtccgtttgatttcccacctcacacttctgtcgtgaggagtgagtgagtcccagggtggaagggcacatagctaatctgccaactcatggaattaggagctgcccgcttttcaaaggaagacacacaggcagccaacaagcatatgaaaaaaagctcaacatcactgatcattagagaaaggcaagtcaaaaccagagtgagataccatttcttgacagattctgagattgtggagaaaagggaacgcttatgcactgttggtgggagtgtaaactagttcacccattgtggaaaacagtgaggcaattcctcaaagagccaaaaatagaactaccgtttaacccagcaatcctgttactgggtatatacccagaggaatttaaaatcattcgaccataaagacgcatgaacacgaatgtttattgcagcactattcacagtagcaaaggcatggagtcaacctaaatgcccatcaataacagattggataaagaaaatgtggtacatatacaccatggaatactatgcagccatcaaaaatactgagattatgtcttttgtgggaacatggatggagctggaggccgttatccttagcaaactaacacaggaacagaaaaccaaatattaaatgttctcacttataagtgggagctaaatgatgagaacatatggacacaaagagggaacagcagacactacttgagggtgaaaggcgagaggagggagaaaagcagaaaaaataactattggatactaggcttggtacctgggtgatgaaataatctgtaccacaaacccctgtgacataagtttacctatataacaaatttgcacatgtaattatgtccatgtccttgtgtagtttaggggaatcatttactatcatgtaataaatccctgcttctccttaccggtgggtctgaaaacagtcttgcccaaatgtgaagcaactcagtgcggatcaatacatgatattcacctgaggtacagccgggagtcccatgcccattgacgttttctttgtctgtggactctgagtacatgtgggcatctgtcctgtctgacagttacccaggactctcattatcagtcttaattcctctggaggttgatgatccagcccactggacaaactacagctcataggccaaatccagcctatggcttgcctttgtaaataaagttttattaaaacatggtcgtgcttattcgtttatgtattgcctatggctgctttcacccaacactggcaaagttgagtcattgtgacagagacctgcaggctcgcacaactgaaagtatttcccatctggctctttatagaaagagtttgctaacctatggtccagctctttgagctcctagcttacctctttgatctagctttctgccttccctccaaagtgaattttgtatatgccactgtagcctaggttgtaactcacaacaggtttacaatccacatacgttgaaagttgactgatgcaatagcagactaacagattatttttcttccctgacatgaggttaagctccttgagagctgggaccagagaattttctctgtcatctgctccttacctggccccaccaccgtgcactcggtcggccttcagcctcgagggtcttgtgactgaccggattctgcttcccttcttgtccccgattcctcaggccctcccagtgaggccatgtgggccttaggagataagatcgcctccaccgttgtcgcccagacgctacaggtcccaaccctgccctggagtggaagcggtaagggaccccgagcttccctctgggggagcttctcagcccagtcttgataatgtgaacggtcagggtgacagaagtatgcttgtaacaattctttccattacaaatgttacttacttttattttttagtcattagcaaaatattttaaaattttaaattagtaaacaagtggtataatttattgtaggcaatttagaaaatacaagaagtacaaaaaagaaatggaaatcattcataatcctatgacccagtgttgaacatttattacattgtaggtatctacctttccaacctttttctggccatattctttgggaaaaaaaaaaaaaaaagacagatcttggccagtggctcatgtctgtaacccaaccccccaacccagtgctttcagaggctgagggaggaggatcacttgaagccaggagttcaagaccagcctgggcaacatagcaagaccccatctccagaaaaagtaaaaaaaaaaaaaattaactggttatggtggtgcatacctgtagtcccaactactgaggaggctgaggcaggagggtggcttgagcctaggaggtcgaggttacagtgaactatggtggcaccactgcactccagcctgggtgatgagaccctgtctttaaaaggaaacaacaacccatcttacatttcctagtttgtgactttttttttcctcactaatgaatatctttctatgtaaaaaatacactttacaccatttaagatgcctgcataggattatatcttatggatgtatcataatttacttaacagtcctcatggttaaacaatttaggttgtttccaatttattttttctaatttaaaaaatattcaaaggaatggagctttgataatcttacagctaaatttatgtgtgcattttaataattttcttaggataaattcctaacagtggagtttctaggacaaattaaaaaataaataggaccgtctcaaaagtttcctattaaatttgtttttttttccccccccaaaagttgaattttaaatttgggatggaaaatttgctttcatttgttaaatctttgcatggtgttgggaaataattattcacatataaatgactccataaggtagaattgggatttttttttggatttagattaatatggttgttgttggtcgactcagtctgagtttctttccttttttgttgttttgttttcgagacagggtctcactctgtcacccaggccaaactgtagtggcatgatcatagctcacagcagtcttgacctcctgagctcaagtgatcctcctgtatcagcctcccgagtagctgggactacaggcccatgccaccatgcctggctaattataaaattttttttgtaaagacaaggtctcactatgttgccagggttggtcttaaagtcctgggttcaagcgattccccccacctcagcctcccaaagtgctgggattataagcatgagccaccacgcctggcagttagtttcttaagcttgatttctcattcaaggttgggttagttcttgaggaaatgaaaagccattgtgagaagctgaagggagtgtctgtattccgctggtccagaagcccaggtctagcactatgtcagcagggagaggcgctgtggtttctgggttgtgtgtgtttctcctggatttgggaggaatcaggtttctttgtgactctccaggcctgacagtggagtggacagaagatgatctgcagcagggaaaaagaatcagtgtcccagaagatgtttatgacaagggttgcgtgaaagacgtagatgagggcttggaggtaaatgcagagcctgtgggggccaggggagccagaaccgaactgcctctgtcctggtagcagttggcaactggctaacctctaaagaggtctgtttgtcctttgcacccaggcagcagaaagaattggttttccattgatgatcaaagcttctgaaggtggcggagggaagggaatccggaaggctgagagtgcggaggacttcccgatccttttcagacaagtgagcagttcttgctgtgtcttttcgcatctgtctttgggaattgtttgtgggctgccagattatttctcttagcattattctgtgacagtcaagaagacatttgtaggagctggatgtatcgttgtatcgtattttgcaacaaacgcgtacatttttactcagaaaagcccatggttttgtgtcgatcttgacagaatcttttaggtagttcaagtctataaatcagtgtatctagaaatgatttcagagatacaggatcaaaatagctgtttgtgactatattggcctatagaggaatgggatattttataaatattagtactcttgttatttctaatgtttctagatggtctattttattttatttttgagacagagttcactctgtcacccaggctggagtgcagtggcacaatctcagctcactgcaacctctgccttccaggttcaaacaattctagtgcctcagcctcctgagtagctgggattacaggcgtgtgccaccacacgcagctcatttttgtctttttagtagagacagagtttcaccatgttggctgggctggtctcaaactcttggccttgagtgatccacccgccctggcctcccaaagtgctgggattacaggtgtgatccgctgcgccctgcctgatcaattttaactgtaggaacgaattgcacatttacttactggtagctagttttcctcttttaaaaccttatgtccgttatcagcaatgtttagaaaacatttatactgacaatcttcccattcttaaagctattttaatatttctagcttttcttctagaccttcttcatatgtatattttaaagagctgtattcagtctacacgaaattttgctctgcatttaacacattccaaattgtagatcatgaatattattatgttattcctgccttggcaattattttgatgattactcaatattttatgtgtggcaatagccttatttatgaaacctttccttttttgttaaatgtttagcttatttctactttgttattatgaataataataccacagtataatgtgatatttagtactataaataacacttagctcttttttcttcttaattattttcttggataaagacttggggagaaagacttagttaaatagcacacactttacatgcactttgaaacacatatcagtacattgctttctaggagttttactaattataccactcttggtataatatgtgaatgttgtataaagcagcagtttcactaccattgtatcgctgttggggtgtacaagtgttttggggatttgggtggggggaagaattgatattaaaagggaagttgcagcagcagtacagaaagttcacatctatccttcgcccggtttcactcgttaacatttttcatataactttgcaactaagagattaacatgggcacttttctgtttggtaaactccagactagattgaatttcatctgtttttgcaccaatgtccctttcctgttgcaggattcagtcctggattccatattgcattaggggtcatacagattttaaagcttttttgctttttaaaaaatagactttatttattagagcagttttagggtcacagcaaaatggagcggaaagaatagagagttcccacataccccaggccctcatgtgcacacagatgcccaagcttttttattttacttatatgagtgcactatgaatatgttcttaatgtagagagtcagtcaagtcagccatgtgttaagaataaaaaaggaaaaacccttttccccattaccttccaactctcctttctcagatgtaaccactattagcagctgccgatggtggggggctcttttcagcactgtcactgtatatacttttacatagacattcatacagttgtttcattattttttgcatgacttcatcctatacattattgcaaatttgttaaacttaatttgtcttagaaatcattgcacgtgaatacttttcacattgtctttaagaatctctagaagacatgcctataaaacaatgcctttcagctcttaacaggatgaagtaagtttgtccttagattccacccgggagagctagctgagaaagtgcagtaagtggaagaaaaagacaaccacagattagtgtgttttggtcccattttcattcaaagaaactttctctgtatgtgttgctatatgcatagaagaaagccagtttggacaccaaactctttaacagtgcaatatctttaggggatgtgactgtgggagattttaccatttcacagagtttgacttaaaaaagagaatatgttgcaggtagtgactattgggctggcggtgcagctggtaaaggaatttaccaagacagctgtaggtaaagaaaggcagatttattggaggaagtatgaaaatatgttgcaagattgcaacaggcagcacagcagagaaggatctgtctgcaaagaggcaagggctggtgggaggttttatagggtggtgctggaggaggggctgtgaggtcattacgtcctggggttgtttgtgattagccatctctcgagcagttgttcattgttcttccccacctggggccgtcccccacctggggcccctttctcctcgttactgtggagtcgggactccacagaatattatgtctgtgagacaacaaaagtaaaagatcagcagagtcctggatgagtaccctaaacacatcactgcgtttgttttatgttctctcctgagaacttccagaagcttccagagctggtttccccatgaagatcaggctgctctgcttcccccgacaggtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcaggtacacttctcagagcccagggggcagcttcagagagagccgtctcagctcagagtcaggaagaactttctacggtcagtgtggctgaatggtggcatgggtgcctaacaagagggatgagggcccattccagaggtgatttcagcatcacacaggtttattggattagccggtctgtgaactccccaaatatttcttttcttttttgagacagagtctcactgtgttgcccacgctggagtgcagtggtgcgatgatagttcacagcagcctgtaactcctgggctcaagtgatcctcccacctcagcctcccaagtagctgggactacaggaacctgtcaccatgtctggctaattttaaaaaaaaatttttgtagagacagagtcttgctatgttgcccaggctggccttgaacttctggcctcaagtgatcctcccgccttggcctccttaagcgctagggtgataggcatgagccaccacacctggccagtcccaaaatatttcacatgtagcaggtgctcagtctgcatttggtgaaggaactgatagtcaccatttacagttccctgaaaagacctctggaacccccttggcctctttctgtttcttcacagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacaggtgagaaaatgggcttggggccctgggacttctctgccctgggtcaggggtccatgtgctgctcccattagtccatcccgcccatctcttggccgactgtcccaggggaatgactggccaaagagcactttgagaaatctgtaaaagctatagttctccctgggaaaatatcttttatacaatttcaggacattcatagacctagagaaatgtttcttaaccttgttatcattatcactccctgcaaggatcctttggacacattttatatcctaatccctgtcttgtgaaattttaatatcacaaatataccacatacctgtttggatattgtagatatatctgtgctttattcatgaaaagagtgagattttcttcactcccaagaacaaatatttgtctcttcagaggcaatatcatccctgttaagaatatgtgatccagagttgtaacctcttgggttaaagggaactctaaattttttttttatttttaattttgatgggtatatagtaagtctgtatatttatagggtgcaagagatttttgtttttgtttttgtttttttgagacggagtcttgctctgttgcccaggctggagtgcagtggcgcgatctcggctcactgcagcctccgcctcccaggcatacaatgtgtaataatcacatcagggtaaatgggtatccatccccctccagcgtttatcctttctttgtgttatggtgttatgaatattccaattatactcttttagttaattttaaaatgtacaataaattattgttgactgtagtcaccctgttgtactatatcaaatagcaggccgtattcattctcttaatcactacatttttgcgcccattaatcatcctcgctttccatgcccctacctcttcctttccagcctctggtaaccatcattctactctctgtgtctgtgagttccattgttttaatttttagctcccacaaatgagtgagaacatgcaaagtttgtttttctctgcctggtttatttcatttaacataatgttctccagttccatccacgttgttgcaaatcatggtctcattcttttttatgtctgaatagtactccattgtgtgtatgtaccacattttctttttcctttttcttttcttttttttttttttttgagatgcagtctcgctctgttgcccaggctggagtgtagtggtgcaatctcggctcactgcaacctccacctcttgggttcaagcaattatcctgcctcagcctccctagtagttgggattacaggtgcacactactatgcccagctaatttttgcatttttagtagagatggggtttcaccatattggccaggctggtctcaaactcctgacctcagatgatctgcccacctcaacttcccaaagtgctaggattacaggcatgagccactgcacctggcctgtaccacattttctttatccaatcatctgttgatggacatttaggttgattccaaatcttggctattgtgaatagtgctacaataaacatgggagtacagatactcttcgatatactgatttcctttcttttgagtatatatttagcagtaggattgctagattggtagttctacttttagttttttaaggaacctccatattgtcctccatagtggttgtactaattttcagtcctaccaacagtgtatgaggggtcccttttctccacgtccttgctagcacttctttttctgttttctttttcctttccttttttttttttttttttttttgagagtgagtcttgctctgttgcccaggctggagtacagtggtgcgatcttggctcacagcaacctctgcctcacggttcgaacaattctcctgcctcagcctcctgagtagctgggactacaggcgtgtgccacgacgcccagctaattttttgtgtatttagtagagatggggtttcaccgtgttagccaggatagtcttgatctcctgacctcgtgatctacccacctcagcctcccaaagtgctgggattacaagcttgagccaccgcgcccagctgctagtatttcttattgcctgtcttttggataaaagccattttaactggagtgagacaatgtctcattgtggttttgatttgcatttctctgatgatcagagatgttgggtgccttttcctatgcctgtttgccattcgtatgtcttcttttgggaaatgtctattcagatcttttgtctgtttttaattggattcatgagacttttttcctactcagttgttttagcttcttttttgtttttgagccagggccttgctctgttgcccaggcaggaatgcagtggcatgatcatggctcactgcagtcttgacctcctgggctcaagcgattctcccacatcaacctcctgagtagctgagactacaagtgtgcaacaccatgcccagctaactttttaaaattttttgtacagataaggtctcactatgttgtctaggctggtctcaaactcttgggttcaagcagccctcccacctcagcctcccaaagagctggtgttacaggcatgagtcaccatgctcatccttgagcttcttatgtattctggttattaatccctcgtcaggtggctagtttacaaatgttttctcccatgctgtggattgtctcttccctttgttgattgtttcctttgctgtgcagaagtttcttaacttgatgtgatcccatttgtcctttttttgctttagttgtctgtgcctttggggtattactcaataaatttttgcccagactgatgttcctgagagttcccccaatgttttcttctagtagtttcataatttcaggtcttagatttaagtctttagtctattttgatttgaagaatttgattcttcatttatgattctgcatatggatatccagttttcccagcaccatttatcgaagagactttttccccattgcatgttcttcgcaagtctgtcaaaaatcagttcactgtagatgtatggatttgtttctggattctctattctgtcccattgatctatgtgtttgtttttatgtcagtaccaccctgttttggttactgtagctctgtaatataactcatagtcaggtaattcaattcctccagtgtttgttcttttttttcaggatggtattggctattctgggtcttttgtgtttccatataaactttaggatttttttttctatttctgtgaagaatgtcattggtattttggtagggattgcactgaatctatagattgctttgggtaatatagccattttaacaatactgattcttccaaaccatgaacatggaatatctttccatttttgtgtgtcctcttcaatttctcacatcagtgttttatgctttttattatagagacctttcacttctttggttaagtttattccagggattttattttgtttgtagctatcataaatggaattactttcttgatttttttttccagaccattcgctcttggcatatagaaatgctactgatttttatatgttgattttgtatcctgtagatttactgaatttgtcaattcgaattgtttttttggtggattctttaggtttatccaattttaagattatatcatctgtaaacaaggataattggacttcttcctttccaatttggatgtcctttatttcttctctaaattgttttcattgttttcttccttccttccttctttcttcccataatggggtctcattacgttgcccaggctggtctccctcccttcctctttttcttccttcagcagaattttttaaaaagttttctttatttttttttcagtttgaaagatttcaaaaaagttgcaagaatgatacaattaatacccatacgccctgcatatagatccatcagttgccacatttgctttgtctctcttctgtctgtttgtataattttagggggctcaatcttttttttttttctttgagatggagtctcgccctttcacccaggctggagtgcagtggtgcgatcttggctcactgcaacctccacctcccaggttcaagcgattctcctgcctcagcctcccgagtagctgggattataggtgcctgccaccacacccagctaatttttatatttttagtagagacggggcttcaccatgttggccaggctggtctcgaactcctgacctcaactgatcagcccacctcggcctcccaaaatgctgggattacaggtatgcaccactgtgcccggccgtgggctcaatcttttgagcaatggtttgagtgaaccttcgtaacatatggcctctgaatacttcattctaaaggcctcctacaacaagagcattccggtccaatgccctagtgcaattatgacacttgagaaatagagcattgataccacatctatatctaatatataccattcacattaaatattttccctgttgttccaataatgtctttttgtagctgttttttgtctcttaaatccaggatccaacccaacccagggtgacacattccattttattttcatgtgtctttaatctctttaatctgaaagcatttcgtagtcttttttcatccttgacattggcattaaaatttttttttttttttttggtgatggagtctcgctctgtcactcaggctggaatgcagtggtgcaatcacgactcactacagattcaacctcccaggctcaagtgatcctcccacctcagcctcctgagtagctgggaccacaggtgcaagtcaccatgcctggctaatgtttttttaattttttctgtagagatcgggtctcattatgttgcccaggctggtctccaactcctaggctcaagcgatctgcctgcttcagcctcccaaagttctgggattacaggcatggacactggcatttttgaggagctcaggcagaatgtccctcattggatttctctgattgtttcttcctggttcgattcctgctacacattttggcagaatactacacaggtgttgtgtccttaatacatctcatcatgaagcctgttaaatctgatcatttggttaagctggttccataattgtctactttttacccattcttcatgtccagtttccccttcgggtgccctttacaaaaacttcctttaactctgcagccaacatggttgcttctcaccttccctagctctaaaagtctagtgcttttacttgatgcatgtattttcttgttgtgtgatgttgtttcataaatatttttccttttcccaactgtactatttgctccactgtgaaaagttcatgtcttatggctttttctttctttggctctctggccacagtagagcaccatgttgtctatagagtagtgtctgtatatcctaaatcattgactgaacctccgttgcatctaccactgtgcctggtgttttggggccgtgttctggtaggactgacagtctgtgggttggatctcttgattttagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgaggcaagttatgggggcccctgtgtttccaccatctcagatctcccagcatgtgggggaccctggatgttagcctgggaagagacacccacaagctatccaggcatctcagtttacaaatggggaaactgaggcatgggaagggacatcccatggtttatttgattattggatttattggatttttatttttatttatttttatttttttgagatggagtctcaccctgtcacccaggctggagtgtagtggcgcaatcttggctcactacaacctctgcctcccaggttcaagcgattctcctgcctcagtctcccaagtagttgggattacaggcgcccgccaccacgcctggctaatttttgtatttttagtagagacggggtttcaccatattggccaggctggtctggaactcctgaccttgagtgatccacccgcctcggcctcccaaagtgttgggattacaggcatgagccaccacacctggctggatttactggatttttggattattgccaggctctgggccgagccttcccatgtctcactgctcacttataggacactactgctgctggacatcgtcaccccacattacaggcaaagagcctggggtaacttgcttcctgtctcccacctgggacctgctgagacccatcagtggactccaaaagccatgcctatctttgggacaagcagccaggtttagaaccctagtccttggatttctggccccgtgtgctttttgctacagtatgaagtctggctcattgtagagagtccctttgtgacttggccttacttgggtcttaaaaaacaaaccaactggcatcccttacagtttacatgcataccgaccgttgattgtcacaggactcatcaatctactacaacttaattgcttaattattaccctcaggaaactgggggtaagagagggtacacctccaccccttttaattaaataattttaagctagggtagctgtattcatttagggttcttggctgtgaaccaaacaccaactctggtggacaagcaaaaggggaattttttggagggatgatggctcgttcccaggttcctaggaggatggaggaccaggtatggtaacagcccaggcacttgggtcgctccatctctcacttctacatacctctccccaaatccttcatcccttagttcaggagccctaatcccagtgagaggtgccatgtccacccactcttaccaaaattgtacttagagggagacgggccgttctcccagagggaatcaggtgtgtgttggcagcagcctggccgatggggtgaggaaaagggggatggagggagggagggaggaaggggtaggaaaggaaggagggaagaggggagtgaggaaggacgaagggagagagggaaggagggagggaaggaggaaggaaggagagaagaaaggaaggaaataccaacgaaatggcctcttccctagcagcaagggccctgcccaggatgccctggatttcttcacctgcagaggttttcattatccagaattggaaatctaacctgtcttcacttctatttaaactttttattttcgaaatgtcaagcatataaagtcagaatgtcccttcactcagctccatcaatcatcaatgttcgcccatttaacacctgcactaccatctctgtcccaactcgcttattttatttatttatttatttatttatttatttatttatttatttatttgagacaggttcttgctctgtcacccaggcgggagtgcagtggcgtagtcatgcctcactgcagcctaatctcctgggctcaagagatccttctgcctcagccccacaagtagctgggactacaggtgtgtgccaccacacctggctaatattttaattttttgtagagatggggtctcctgatgttactctggctggttttgaactcctgggctcaagtgatcctcctacctctgcctcccaaagtgctgggattacagacatgagccactgcgactgaaccaacttcgttatttttttacagttaaaaaaaataagaattataggcattgaggagctcatatgggtacacccatgaatagatacatccatacctgtaacaagcgatatcagtgttctattgactaccctaagcttttggtcagcgtaggggttcttgggttttcccaggactgaattctgatgaaaatatatctggagtaatgatttcttccattttgcattttctgtccggactccagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgtcagtatctccttccttccttccttccttccttccttccttccttccttccttccttccttccttccttccctctctcccttcttcccctcttccttccctctttctcctcccttcctttcttcttccctccctctcagcctttctccttttttccttccttcccttccattgccttcctgccttcctttcttccttccttcctcccctcttctgccctcccctccccttccatcccttcccctcccttccttcctcccgtccttcctcctccccttcccttctttcctcccttcctccctccttccttcttttcctgacttctctgctttcctccccctccctttcttcctccttctttccttccttccttctttccctcccttcccacttcctccttttcccaattccttcctttaagaaatgaaacggtcccctggggcttcagatacagtagcatttcaggagaccaagaaaagtaaatcacagggtaggccccatttaaaataccctgtgcttgaagttcaagatcaaagcctgccctttttttcctttattgaagatccacaaagtaaaataagtgcaccaaggtcatttggtcttgagcttataagagttctagcttgaaggagatctaaagattgttctaggagatacccaaagtgtaaaaggtgctaagtaccatagctgaagaaagggggagggaaactcctttacatttaaaccttatcagtagttccctaatgggttgtatttcacaccgaagactaaattttaaggagtgtgtcctgctgtgaaccacccaccactctgaggcctgtgacagcagccccatgtccccagctcagccaagtcctcccatacttgtgatagtttctgcagagctgagaagcccacattgacagagggacccccaaattctgacacaccatctccgacacttctcctggcttgacatgggtgtggaaaggtataaaactagtttactttgtaattaaatgtttttgtgtgggtaactgcccttcggagtgaaaaaatcccaaaggccttagcattaaaatctgacgtggggcacttagccacgaattaaattgagttgggcagttttgatgatcaggttttctttgccagcttagaataattaattttaatcatgcttagtgaaaaatcaagatccttgaagtttatggaagattgcagcaaaaagggcttacttaataggagtaggcggaagacaggtcagccagcccagacccctccgagtgaagtgacctgtggcttgtcacatgctacgagtggaccaaccgcaacttcaacagaactcacaggcagaaattccagcttttcttattgctgttagtgagagtccagtagggggatcaactgtcctcgttttcctggcaccggtttctcaggttgaaggacttctcagtgctaaaatggggaccaccccaaggaaactgggacaagtcactcacccgtgagaccagcgggttaactctcatacccagcttccagacccacagctgacttttcatggcctatggatacccttgtatgaccttactgggtcttcattttctcacccccaaaatggggtcatcagtgtccttccccgttacctgctgacagcacacaggatgctgcaagacatgaaagcttactcggccaggcacagtggctcatgcctgtaatcccagcactttgggaggccaaggcgggcagatcacttgaagccaggagttcaagaccagcctggccaacatgacgaaaccccgtgtctactaaaaatactgaaattagccgggcatcctggtggccatctgtaatcccagctactcgggaggctgaggcaggagaattgcttgaacctgggagatggaggttgcagtgagctgagatcgtgccatttcactccagcctgggcaacaagagtgaagctccgtctcaaaaaaacaaaaaaaagaaaaaaagaaagctttctctcccagaagaagaggtgttcagatacctgcccacactcaccatgaattcatagggctcagcttcccgagtagctgggactataggcgcgtcccaccacgcccggctagttttgtatttttagtagagacgggatttctccatgttggtcaggctggtctcgaactcctgacctcaagtgatccacccgccttggcctcacaaagtgttgggattacaggcgtgagccactgcacctggcctgaggtttagctatttgaactggtgctcttggagatttggagtctgtgtgttggggagaggcagccatggggcccaccaggcccctgagccgggtgacagtgccgtccatctgcaggtgcaccccacacacaccaggcagagcagctgtgtggaaggtgagagggtggcaccagctctggggacaggagatttgaataggtcaagggagagacagaggcggtgaccgattttccctttgtttttttttcttcttttaagagatagcgtctcactgtgttgcccaggctggagtgcaatggtgtgatcatagctcactgcagcctcaaactcctgggctcaagcgatcctccccctttagcctcctgagtagctgggactacagtcacataccatcacgcttggctgattttaaaatttttgtagagatggcgtctcattatgttgcccaggctggtcttgaactcatgcctcaagcaatcctcccgcctcagactcccaaagcagtgggattacaggcatgaaccaccatgcctggctggttctttctctactaatcattaactattatagtcaataattataacaataataactaatcacgttcattgtagttaacatttattgatcagtgaccatgtgcattacatggattgtctcatttcaattctcgaacaccctcatgaagtcagggctatttccccattttccatatgaggaaactgaggcccagagttctcaagtcacttggccaagattagccaggcagtaaaccctggcgctgattcaatgcactggctgtgtcagtcagagccctctcttaactcttctttttttttttttttggagacagagtcttgctctgtcgcccagcctggagtgcagtggtgtgatctcagctccctgcaacctctgcctcccagattcaagtgattctcctgcctcagcctcctgagtagctgagattacaggcgtcctccaccatgctgagctaagttttgtatttttggtagagatggggtttcgccatgttggccaggctggtcttgaactcctgacctcaagtaatacacctacctcagcctcccaaagtgctgggattacaggcgtgagccaccacacccggccactcctgtgcttttccagttctctgaatcacatcattgcagcaactctgttgatgtatgcatgaatttggaaaatgatccatgtgcctttcccttcaaggaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggtagggagtgagctgcctgtgtctcccctctggatggccgagacctcggcttcctgaggatactgaagtgcattttctcctaggcggagaaaccggatatcatgcttggggtggtatgcggggccttgaacgtggccgatgcgatgttcagaacgtgcatgacagatttcttacactccctggaaaggtaggggctgtggcagttcccttctgcttttgtgatatgtgttagcggcttaggaggctgaatctgtctcctttatttgtgtggccagttagtcaccaggcaattggtgagtctctcctccggtcttgcctctgggaaattcctctacagatcaacctaggctacccttgaagaggctgtgggttagggaatgggattctcgaggccagggtggcagtcagtgaacaggctgttgtgtacggatccatgctgacttgtgtaaggtacatcataatagtcaggagttctgagttcaaggaggtggatttgggaagcaaagcggcttaaaggtcatctctacaagcgggtgcattcccagaccctcaccagaatcagagggtcatcatgaaatggaccagaatggaaagcaaccaggcgatctctgttaggataggccggggtttctcagcctcagcaccattaacattttgtgctggatgctttttttttgtttgggaacctgtcccgtgcatcataggatgttagcagcattcctggcctctacccactaaatgccaggagcagcccttccctctgagtcatgacaatcaaatatatctccagacattgcccaatgtcccagggttaggagtagaataatcacccccagttgagaactgctgcaagaggcaaaggaactatcaaaaagaaaataaaaggataaacttttttttttttgagacagagtcttgctctgtcatccaggctatcacccaggctagagtgcagtggtatgatcacagctcactgcagcctggacttcctgggctccagtgatctgcccacctcagcctcccaagtagttgggaccaccggtgcatgccatcatgcctggccaatttttttaactttttgcatagatggggtctcactatgttgccccccaggctggtctcaaactcatggcctcaagcaatcctcctgcctcaactctgaaagtgctgagattataggcgtgagccactgtgcctggtaagaaatgtttttagtgtttggttatgcttttgaacggtagtagaatcacagtccctgctctggtttctttcataagccgaaggcaggatcccatatgtgaaatttttccaagagaccgttatggattttgctcctgaaaagcctttgtaagatttcaaatccctcagcaagtgctgattccttaagttctaagcaatatcaggctgctcagggtgattcaggttctgtgcgtgacttttaatcagatttagccttttttttttttttttttgagacatagtctcgctctgtcacacaggctggagtgcaatggtgtgatctcagctcactgcaacctccgcctcctgcattcaagcaattcttgtgcctcagcctcccgagtagctgggatgacagctgcatgccaccacgcccggctaatttttgtatttttagtagagatggggttttgccatgttggccaggctggtctcgaactcttggcctcaagtgatgtgcctgcctcagcctcccaaggtgcagggattacaggcgtgagccattgcgcccagcccaggcttagcatttttagtgcagtcaggtttgctgatgcagagagttgcgtaatttttttaaatgcaagggatggctgtggagttctcagtccctcccaaggctgaccacaaccctgtcttttctttcaggggccaggtcctcccagcggattcactactgaacctcgtagatgtggaattaatttacggaggtgttaagtacattctcaaggtaaatgcccccgtgcctctccgatgtctccaacactctgcaagcttcagggagtttctttcttccatgaaccatccctggagtggatttgctcatgcttgggtttgagctcttgtgttcctcgggaatccccatgtagtccgtgaccttgacacctaaacactttggcttttagaacatgtagggctgtgcattctgcagagggcacaatggagcgtggataagtttcctgtagctgcggtaacaaggtaccacaaactggtttaaaccaacaaaaatttattgtgtcccagttctggaagccaagtctaaaatcgaggtgttggcgggccgtggtctctctgaaggcgctggggcaggatctgttccgagcctccccagcttctggtgctgctggcagtccctggtgatttttggcttgtggatgccttgccccagtctctgtctctgttttttttttttgttgttgttgttgttgttttttcaaacggagcctcactctgtcacccaggctggagtgcagtggctcaaccttggctcactgcaacctccatctcccaggttcaagcaattcttctgtctcagcctcctgagtagccgagattataggcatatgccaccatgcctggctaatttttgtatttttagtagaaatgggatttcaccatgttgcctaggctggtcttgaactcctgagctcaagtgatctgccctgccttggcctcccaaagtgctgggattacaggcatgagccaccccccaacctctgcctctgtgtgtgcatgtgtgtgtgtgtgtgtgtgtgtgtgtgtgtgtgtgtttacattggcctcccaaagtgctgggattacagtcatgagccaccccctggcctctgcctctgtgtgtgtgtgtgtgtgtgtgtgtgtgtgtgtgtgtgttcacattatcttccatgactgtgtctttgtgtctcttctcttgtaagaacaccagtcacattggatttagcgtccaccctaatccagtatgatttcatcttaattacatctgcagagacctcattccaaataaggtcacattccaaggttccaggaaggccatgaattttggaggatattattcaacccctatagaatgtgagctgggcctttgctgagacagaatagtgggcccgggtctgtttccaggggctctgaggctggttttgttctctgtctctgcaccacgtgtagattactggcatcttccctggtttactactggagtccctggggcttattccggttgctctcctctgtcagaagtgcctagttgccctttgtgggccatccaaggtcaattcaacagtgtcagaaatgtctctgagatgcacaggtagggggtgaggcttggtgtcctagccatggtgttctgggcccagggtccttgttggggtgagccggctgtggcatcagtgccccgggttccaatgcaatggcaggaggctgtgtcccctgtaagcccaggcctgcccagtacttcccagcctcacattgtcaggagggaaaagaggacagagtttgagtctgcttatgagacagaatttttgttttctttaattagtactttctatttaatattgatgagcatgagtagaactcacaactttggagatttgggggctttagttcaactaaacctgtgtgtcattgatcagggtatgctttcacaatcatcctcctttgcccctaatgcctcttggctacctttggggacctagctgcccccaacttgattttaaatgtcacatatgcacaatgtagaaaatttcaaaatttcaagcgagcataaaaaatcaggaaaacaaatccatcatgtgctaatgcctagaggtaatcctggtaaacattttagcaaatctttgttatatatttttttccttttgcattaattttacaaagttgagatcatggtgcaaatgcagttttacagctttgatatgatcatggcataaagttttccatgttattaacaagttttttttttaacacgagtctaaactcatgtctgtggcactgtctccctgaacttttaatagtgatgggaacattccctatcttctgtgtccaagatgctgcccttatgtggtgactgagagcttgaaagtggccagtgtgactgaggaactgaattttacattttatttcattttgatcagtttaaatagctgtgtgtggttaggggtcaccgtatcagacagggcagatctaaagtgttccattgcaaggttgttggcttgctaattttgttctaatttttgttgttattacaaataatgctgcaatacacattcctctatttcttgctgccttgtgtcataaactgtgaattttataggttgaaggccctttagggtgtgtgttttctgagagaaaactgaactgaagtaccagatggggcaggcgctcttcctggagggagatgtagtgctggggccagggcttggctgtgtctctctcacgtgtcccaaagctcttgtgtgctcctgggcagagctgggtctgggaagcagagccctagtccatgtccaggtgtcttagtccatttgggctactgtcgtaaaataccaaagactgagtggcttctaaaccacacactgaatttctcacaattctctaggctgggaaggtcaatatcaagatactggcagatttggtatctactgaggacccacctttcgtttcatagatgctgtcctttcgctatgtccttagatgtcagaaatgggccacagagctctacaggggatcttttataagggcactaatctcttttacaagggccccaccttcatgatctcatcacctcccaaaggctccacctcctaaagccatcacattaggggttgggatttcaacttatgaattttgcggggacacaaacgtttagtccattgcacctggctgctggtggagtctccagggctgcctcacacagagtgagagctggagacaggaatcagaagggagtctctagccccagaggacatgcagttgccaacacggcttgacagggactatataagcggccattagcctacccacagggcaggtgtggctcgctactccaggcctcccccagccccatcagcagctgctcccttggcaggaattgtgagggctgggtccgagagacgggggtgttcatcttggccctctgtggtggacaaccagctcttgtttgttgttagcggggcccagcagtgctctgggagcacatcctgaacccaggcggtgacaaggggcttgtccccacaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacaggtgcgtgggggtgcgagtcccactgtgggctgggcatgcacagctctctgtcctaggcatggaaaacacagcactggcctgtgtgcaggtccaagggtcttagagaaggtgcctttctggtaaattctgggggtgtgcagagaagttaatctcttggttggaattctgtgcaactggcagatatttaggggaggatcctaggaggcccttttctagtaacctggttggtggggattcagagctgaacgggacatgactcccagctctgtggcctgcgaggtgtgtgaccaggtgcctgctgcctgtgcatctgggctctggcatccacccagttagtgcggcagtgacctactaagctcctccgtaccaggcgctgtgctgggtgttgggatagcattctgggtgtgactcgtggagcttccagcccattcgggaagatgacacactgaacaaacagatagtggcaggaaagggtgtcgtgtacctgacgggtaacacacaagatgccctggaagctcttagcacaggggcttgtgagatagtgagataggccccaaagatgccccgcctccagtgtgtctgatcaccccgagatcacgcaatgaaacagaccccagccaaggtgatgaaaggggaggggatgtctgaaaagctccagttagagagtggagactctcttctcaatcctcaatgttttggaagaaggaagactaggtttatgccagagtaatattttgttatctccttttttttctttttgagagagggtctcgctctgtcacccaggcaggagtgcagtggcaccatcatgactcactgcagcctcaacttccctgggctccgagatgatccccccacctcagtcccccaagttgctgggactacgggcatgtgccaccacgcctggctaatttttgtattttttgtagagacggggttttgccatgttgctcaggctggtcttgaacttctggactcaagcagttggccagccttggcctcccaaagtgctgggattgcagtcatgagccactgcaccctgcctgttatctcttttttaacccacgttctatctgccaagaatgttcaggattactataggttctactctccccagttcaaaggttaagactttgaatcagtaaatatttgttgaatcatatccactgattgatttttctgtgtcaggccctgttggaagtatgtcagtaaaaggaaccagctttcagccaaaaaagggtcacatcctttttattattttattttattttaaagactggttcttactctgttgcccagcctgggcaagagtgagaccctgatcgcttgagtccagaagtttgagaccagtctgggcaacatggcaaaaccccatctctataaaatacaatgattagccaagtgtggtggcgtgtgcctgtagtcccagcaatttagggggttgtgatgggaggatcacctgaccccagggaggtcaaggcttcagtgaaccatgattgtgccactgcactccagcctgggtgacagagtaattatagctcacaatagcctcaaactcctgggctcaaaggattctcctgcctcagcctcctgagtagctgggactactggcatatgctaccacgcccagctatttttttttttttattttttgtagaggcagggtctcactgtgttgcccaagcttgtcttgaactcctggcctcaagccatcctcccacctcggcctcccaaagaaagcatcacagccttggccaggcacagtggctcacgtctgtaatcccagcactttgggaggctgaggcgggcggatcatgaggtcaggagatcgagaccatcctggctaacatggtgaaaccccatctttactaaaaatacaaaaaaaaattagctggatgtggtggtgggcgcctgtagtcccagctatgcgggaggctgaggcaggagaatggcgtgaacccgggaggcggagcttgcagtgagccgagatcgcgccactgcactccagcctgggcaacagagcgagactccgtctcaaaaaaaaaaataaaataagaaagcatcacagcctttttgttcacccacctcactctcagtgtctctgagataactatcaactgccaccctttgggaatgtagagggtacactccccctttaggaaggggaaatggtattgaaagccggactagggcttgctgagttggtagtcctcatcagtctccctacccgactcctcctctctcccagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgactgcagagccggccgtggggaatcctgaaccctcaaactcccactcttctggctttgtcccatgtctgaacaaacaggcctacctctccccttgaccactgtctgcaaatttctaagggaatcagtctgtggatttcagccaaatcccctgaagtattcaaagaaaaaaacttcaggctgggcgtggtggttcacgcctgtaatcccagcactttgggaggctgaggcgggcggatcacgaggtcaggagatcaagaccatcctggctaacatggtgaaaccccgtctctactaaaaatacaaaaaattagccgggcatggtggcaggcgcctgtagtcccagctatgcaggaggctgaggcaggaggatggcgtgaaggcaggaggatggcgtgaacccaggaggcggagcttgcagtgagctgagatggcgccactgcactccagcctgagcgacagagaaagactccgtctcaaaaaaaaaaaaaaaaaacttcaaaaaatgcacatctccccaggaatgagtaagaaggttaatgacagagaaactgggtacagagaatatggaaactctctgtactatttacataactgttctataaactgttgtgtaaatcagtttccttgatttctttattttttttttgagacaagtctcagtctgtcacccgggctggagtgtagtggcgtgatcttgtctcactgcaaactccgcctcccaggctcaagtgatcctcccacctcagccttccaagtagttgggattacaggcacgcaccaacatgcctggcttaattttttgtatttttggtagtgacagggtttcgtcatgctgctcaagctggtcaaatacctgagctcaggtgatccacctgctttggcctctgaaagtgctgggattgcaggcatgagccactgcacacagccaagaattgattgataataacaattattgtcaatcaatgattaaatattaaatattgaccccagcaataattgaaaggtgttaagccaacacttgcaaagccataaccatgtggcaggtgctgttctaagcattttactgatctttattttttaaccttcccagcaaatatatgagatgggcacaaatgtgatccccattttataaaaaagctgggcccaggcaggctaagaaactcactggaggtcacacaaagccaggattcaaacccggaaaataacaacaataatagcaatgaaaatacatcaataatagtagctactgcatattgacctgctgcatggcaggatctgcatctcattcaatcctcgtaagagccctaagaggtgaaactgtcattattcctcattttacacttggggaaactgaggctcaaggaggggagccacttctgaagatcacagaggtattggtgggggcagttcctgggattctagtccaggcctggctgacttgggtgcccaagctgtgaactgccaagcaagagagatagcacagtcctggctctgcggccgccaccatggtgacaaagctcatgccacgcacgtatccagacattcgggaaaattaaaagggctgatgagcagattcttcatttcacagagtgttccctgagggttttctaagtgcctttaataaaacaaactgttcacaaaatgtttgatttatgcagtacgttttaggaacgtgtatatgaaccactctatgtaatatgatttaacagtatttctaagagaagactccccctttggaaataaacatcagtttccatatctgtaaaatgggcatcataaacacctccttggctggctttgcagattgaatggcacttgcctggcacttagcaggcttccagtaaaggtcacttttccttgtaccttctgcctgaacactacccagggagtcattctggcgcgtccctgggtagtgtcccggcgcgtccctgctccggcatcactagttctgggtggctctgggtgtcaatcccggtgggctctgtactatttcttctttttacgaaataggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggtatgtggctccacggcccaagtgctctggctggtgcaggtgcactcgtgacctccactggttcagtgagacaggtggactcaaggctggtagcgcttctcctgcctccacctgcagacagagctcgtcgcagcagccaccgtgatggtgcagaaacacaaggaagccgcgccctgctttactcagatccctctctgtggctctccatcctgcttagagcaaaacccaatttctgccagtgacctgcaagaccccaaatgagctagctgttccctgctttcttctctgcctttctcctctgtccctctccccatcacttacttgaatacactggacccctccctcctggcggctgtcctctctgctgtgaaggacctaccccagactttgcagggatcactctcaactcctgggagctttgattccaatgtcttcccctcaatgagggcattcttgaccattgaccaccttttctttttaatagacttaatttttagtatagttttagatgtacagaacagttatgtaagtagtgcagagttcccatattctctgtggccagtttccctgtcattcatttaattatcattcaattaattgttagtattattattattattcatttttttttgagacagactctcgctctgtcgcccaggctggagtgcagtggcgtgatctcgactcactgcaacctctgcctccctggttcaagtgattcttctgcctcagcctcctgagtagctggggattataggtgtgtaccaccataccagctaatttttgtatttttagtagagacagggtttcaccatgttggccatgctggtcttgaactcctgacctcaggtgatccaccctcctcagcctcccaaagtgatgggattacaggtgtgagccactgcacctggcctcaattaattactattgttatcaatttactgttattaatttaactattattgcacgagcatggtccatttgtcatatttaatgaaccaatatcgatatattaggtattattgtttaagaataataattaactttaaaatttaactattattgcaataatatggtccatttgtcacatttaatgaaccaatattggtacattattgttcactcagatttctttagttcattttttaaaaattgtggttaaatacacataacaaaatttaccatcttagccatttttaaatgttctcttgagcagtattaaatccattcacattgttgcacagccatcaccatcatccatctccagcacttgcaaaactgaaacttgacactcgttaaatggtaactcctgagtccctcctccctccagcccctggcaaccattgttctgctttctgtctatcaattcaactcctctaggtgcctcatataggtggaatctatatagtatctggccttttgtgactagcttatttcatttagcgtaacgtctccaagtttcatccatctgatagcatgtggcagaatttccctgttttttaaggctgcataatattcccttgtaggggtgaatcacattttgtttatccacccatccactgatggacacttggattgtttctacctgttggctactgtgaataaggcagctatgaacatgagtgtacgattttcttagtttttacctattgtccaggatcccatccaggttagcacattgcatatagttgtcaggtctctttcaaccgccctttaaaaaattgtgctcacctccacccacgtgcaaacacacaccgtacctcacaaagatgatctcactgattgtcttgttgctttattatttggcctccaggagactggaaacaccgtgagaacagggccttttggctttcttgctcgctgctggggccccagtgccaaaaacagggcctagtacatcagaggtgctctgtaaatattggttgttggatgaacgtgtagcaggcaggtgccgggggcgtccccctgtcctcaggaccaccagggggtgcaccagagtgtctgtcatgtgaccctgagctcaggctcttgggggcacctccaatttagattcctcttaatttgtcaagctgtgtcattaccgatgagtccctgaggtcaaggactactttcgatgtccactgttgtgatcctggggcttagcacagtgctcggagcatagtgggtgctcagaaataacaagtcttgatgaatgaatgaatgtttacaccctcctaagcaagactctaaaataattagtacatctgtccagtaaaaaaaaaatttaaaaatatcacatggtctcttttctccagagtattctattaattgtatttgttttcttttttaaaaaaattataattattatgggtacataataggtgtacatgtttatgggggtacatgtgatcttttggtataggcataccgtctaataatcaaatcagggtgattggggtatctattacctcaagcatttttcatttctttgcgctaggaacattccagttctactcttttggttagtttaaaatgtacagtcgattttaattgactgtagagtcaccctgttgtgctatcaatactatatcttttttttttttttttttttgagatggagttttgctcttgtcgcccaggctggagtgcagtggcgtgatctcagctcactgcaacctctacctccagggttcaagcaattctcgtgcctcagcctcctgagtagctgggacttaaggcacctgccactatgcccagctaatttttgtatttttagtagagatggggtttcaccatgttggccaggctgatctcgaactcctgacctcaggtgatccgcccacctcagcctcccaaagtgctgggattacaggtgtgagccaccatgtccagcctcaatactagatcttattcattctatctaactggatttttgtacccgttaaccatccccactcccaccagccccactacccttcccagaccctggcagccatcactctacattctatttccatgagtttatttgttttaattttcagctcccacatatgagtgagaacatgctaaatttgtctttctgcccagcttatttcacttaatgtaatatcctccagttccatccatgttgctgcacatgactgttgttacaattcttttcattagtctctttctctctttttttgagacagagtctcactctgtcacccaggctggtgtgcagtggcacaatctcagctcactgcaacctccacttcctgggttcaagcaattctcctgcctcagactcccgggtagcaagtacctgggaccacaggtttgtgcgaccatgcctgactaatttttgtatttttagtagtgatggggtttcactaggttggccaggctgatcttgacctcctggcctcaagcgatccgtccaccttggcctcccaaaatgctgggattacaagggtgagccactgtgcctggcatcactagtctctttagggagttcccaaagctaggaatagactgggcctttttggatcagtgggcaggtctgggtacctgcactgtgattcctttcagcacacatttcctgtgctgggttaatgaggcagggcctgcccacccattccctgcagcctcacataaatgcttgtgagacagactgggagatcgagtaacttcacttggtgagtgtagttagaagaccgcccttggccctgggctgtggggacccacatggagaagctatgatcagattgtgtaggggaaaaccctcaagtcagctttttttttttttgagacagaatttcactccattacccaggctggagtgcaatggcacaatcttggctcactgcaacctctgcctcccaggttcaactgattctcctgcctcagcctctggagtagctcggattacaggcacgcgccaccatgactggctaatttttgtgtgtatttttagtagagatggggtttcaccatgttggccaggctggtctcgaactcttgacctcagttcatcctcccacctcggactcccaaagtgctgggattatggtcatgagccaccgtgcccggccaagtcatctcttaaaaggggagaaaagcctgcagggctaggggtggggatgggtgtgggtggaggggtagagggtgggcaggaaacggagtgttctctgctgggagaacagcaccccagcactgtgcgtcatgcacagtaggtatttgtagaatgaatgagtagacgaatgagcacatttagtctgtgttgccctctagggagctttttatttttccatgtgtttacctaagactgaatttttatgatttacaaaaatcagatgcatttgtatgagatgttcataaattttcatcctactgtgaggtgtttaactttgggattcaatagagaatgaaaataaatacagaacatgagatttgttgattataaagcaaaacaacaacaacaacaaacagatcggccgggcgcagtggctcacccctgtaatcccagcactttgggaggccaaggcgggcagatcatgaggtcaagagatcaagaccatcctggccaacatggtgaaaacctgtctatactaaaaatacaaaaattagctgggcgtggtggcctgcgcctgtagtcccagctactcgggagactgaggcaggagaattgcttgaacccgggaggcagaggttgcagtgagccgaggtcatgccactgcagtccagcctggggacaatgcgagtgtctcaaaaaaaaaaaaaaaacagatctcaccgccaccccacaaaactgtctggggtgtgaaactgtgtactgggccatttgcaaaaggaatggtttggaaaacccacattggggtgtgagtttggccgttttaactttccagttcattgtctttgattttttcctcagacctcatcctcacttgattacggaagccggcagatctgtcctgcctcccgttctgcccggtcccatttggaattcccagagttttcctgacctgtcgttcttgtggtgtctcatcaggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaaggtaaagtcacctatgagcgcaggcgtgtagaccagtgcggagggtcagaagatctaccccgtgacagcagaggtcattattgagtaagaaatgagaaaatggtcggtcctctgttgtttttattttatttattttattttttcagacaaggtctcactctgtcacccagactcactgcagcctcgacctcctgggctcaagagatcctaccacctcagcctcccacgtagctgggactataggtgcaccccaccacgcccggctaattttttgtatttttgtagagatggcattttgccatgttccccacgctggtcttgaactcttgggctcaagtgatccatccgcctgggcctcccaaagtgctgggattacaggcctgagccaccgcacccagcccctcggttgtgtttatgaaggacctgtcctcagggaattcctcaattcaattgtaaacattggcctgactttttctccttgatcgtaaactgggcttgtagcagttcagctcaagactgagaatactccagtaggacattaaggaaggagtcagtgggggtcaccctgcttaaggagatgacagacaaggcactttgtttgaaacacacctctgttcgtcattcacccttgctgggtctcatctgctcactcagtagagaaacaagaagttctctgatttgcagacctccttgaaagacccatgatgctcatagcagtgactaagcatcacactgtgtgctgtaccgggtccgtctcaggagagcaaatcatgatggtgatgacgataataaccgccaacccttagcaagtatgtaccatgtgtcacccccctttgtttttgagagggagccttgctctgtcacccacaccaaagtgtggtggcacgatcttgtctcactgtaacctctgcctcccaggttcaagcgattctcctgcctcagcctcccgagtagctgggattacaggcgtgtgccaccatacccagctaatttttgtattttttagtagagacggggttctaccgtgttggccaggctggtcttgaactcctgacctcaggtgatccacccaccttggcctcccaaagtactgggattacaggcgtgagccaccgtgcccgctgtgtcaccttctaactacttaaaagttcaatcatttcatcctcccagcaaccgataaggtaggaactcttatttccacttacagttgaggcaactgagggacacagagactaagagacttgctgtgcttcatacatgaggaggcaaagatgagatctgaaccatggccatcaggattctgactctgtgctcttcgcccccacgttatgctgcctgatgattattaccaccattgcaacattttttttttttttttggagacagggtcttgctctgtctcccaggctggagtacagtgggggaaacactgctcactacaacctcgacctctgggttcaagcaatcatcccacttcagccttccaagtagctggggttacaggtgcctgccaccacacccagctaattttttgtagagacggggtctcgccatgttgcccaggctggtctcgaacttctgggctcaagtgatcctcccgccttggcctcccaaagtgttcagattacaggcatcagccaccgcaccccacaataattgcaacttttattagttggggcacttcgcagtttatgcatcagttcactttgaaacctcacaaccacactaggatgttggccccactatcatcgtcatccaaagaccatcagcattggctactgagacaccccggaaacagcatagggcagcagttcagagtctcaggagctgaatagcctgggtttgcttcttactagctgagtgactttggttaacttaactaacctctctgtgtttcagttgcctcaattgcaaaatggacaaaatcattagacttcctttatatggttgcttttagggatcaaatgataacatgaaaagaaagttcctagaacactgtctggcactaagcaagtatcctataaacatcagctcatcatgtgaccttatgtttgatcccccacaccatgctggctttctgatgcacagagagggggagtcagggtcttcctatgtagggaaactgagtattcccctgtggtcagggggccattccactctggactgccccagaggctgctgggtctggatcttcagccacttgagtgcatggggtcaggatgggttgagctgtgttgggtgccctgtttggggcggtggtgcccatgcccatgcagggctgggggctgatgctgtggtccccgcttcagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcaggtgcgtgctcccctgcccagccccaccccaccaggatggtcacactgggccggctcccggtctggctcgatatctggcctctgatcaagttgaactccttgagacccacttatagcctaacatatcaggggccgagggtttccttttgagccttgtctgcagaatcctatcatttactcaaagcaacagttgtttgaatgaacatcagtattccttaggcctcattgcctaaaacccaagattctgaataggagtgagcagttgttgcagatggagtgagcatttcccaaaaaataaactggctgacatcattagaggaaactgcaagtttttttatttttgttttttcactggtttgcagctttgattttctgcccctggattttgtaggtgatcatctgggagctccatgtatgtgtgtgtgtgtgtgtatctgtgtgtatatatatatacacacacatatatatgcatatatatacacatacacacacgtgtgtatatatgtatatacacacatacacacacgtgtgtatatatgtatatacacacatacacacacgtgtgtatatatgtgtatacacacatacacacacgtgtgtgtatatatgtgtatacacacatacacacacgtgtgtgtatatatgtgtatatgtgtatatatacacacgtgtgtatatatgtgtatatgtgtatatatacacacacgtgtgtatatatgtgtatatatgtatatatacacacatgtgtgtgtatatgtatatatacacgtacatgtatgtgtgtatatatgtatatatacacacgtgtgtatatgtatatatgtatatatacacacgtgtgtatatgtatatatgtatatatacacacatgtgtgtatatgtatatatgtatatatacacacatgtgtgtatatgtacatatacacacacatatctgtgtgtatatgtatatatacacacacatatctgtgtatatatgtatatacacgcacacacatatctgtgtatatatgtatatacacgcacacacatgtgtatatatgtatatacacgcacacacatgtgtatatatgtatatacacgcacatacatgtgtatatatgtatatatacgcacatacatgtgtatatgtgtatatatacatgtatgtgtatatacgcacatacatgtgtatatgtgtatatatacgtgcatgtatatatacatatatacatgtatgtgtgtatatacatataaacatatatatgtatatatataatattttttaagaattatactgaggtcgggtgcattggctcacgcctgtaatcccagcacgttgggaggccagggcaggtggatcacttgaggtcaggagttcgagaccagcctggtcaacatggtgaaaccccatctatactaaaaaaaaaaaattagctgggcgtggtgttgcacacctgcaatcccaactactcaggaggctgaggcaggagaattgcttgaacccaggaggtggaggttgcagtgagccgagatcgcaccactgtgctccagaaaaaaaaaaaagaatgtactgagatgtcttatcataatcatagttgcatttgtgaacatgttaaaaaaaaaaaaagaatggaagccattccagggaagtaagaaatatctctgttatttacacatcggcctcgcgttgttcattttgttgtggttgttggttttgtggggcatttgaaaggcatttgcactgggaagagcccctctgcctgtttgccttcctgccctctggtgggagggttccccaccatcatcatccacccacccacaaattggtgatttgggaaaccagaggacagtgtagttcaggccattctcggaggttaggagttctatgggttggaatgttgttcagccaaagaaagaaagaatactgattcatgctcccacgtggatgaacctattgtgctaagggaaataagccaggcacaaaagaccacatattatgtgattcctcttttttttttttttttttttttgagacctcccgaatagttgggattacaggtgtacaccaccattcccagctatttttttgtatttttttagtgaagatgggttttcaccatgttggccaggctggtcttgaactcctgacctcaggtgatctgcctgcctcggcctcccagagtgctgggattacaggcatgagccatggtgcccagccctgtgtgattccaattttatgaaatgtccagaataggcacgttcatgaagaaggaagtagattagtggccgccaggggctgcagtgcagggaaaatggagagtgagcgctaatgactacaaggtttctttttagagtgacgaaaatgctttaaaattagatggtggtgatagttgcacaactttatgaatacactaccaaccactgaatgtacactttaaagggagatggtggaatatgatggtgtgtaagttatatctgaactaaaaaataacaaaagccaaactctagaggatcctaactgaaaaagtacacacttggaactttcaggaatttgtcattgatccaggtttttttttctttaaaaatatttttgatgccaaaggcaatacaccgataacattatgtgtaatgataaagacaggacccttccccatgagcaccctggtttttgctagagtgggacattcccatctccttgttccccatcccattgatatgtgcggaatggtataaggcgaatgtgtgcactcctccatgtgatcgctggcattttgagcgcttgaattcctcaccgttgaggggatgaacaggggtgtttcagggtagctggaaggctttgggcctggaattttcaatcttcaaatgagtctcggatgggacctccctgggaggctgtggtgggtcctttaggtcagcagttcccaacctttttagcaccagggaccggttttgtggaagatagtttttccacggaccggggagggggatggtttcgggatgattcaagcacgttacatttatggtgcactttatttctattatgattacattgtaatatataatgaaataattatacaactcaccataatgtagaatctgtgagagccccaggcttgttttcctgcacctagaaggtcccatctgggggtgatgggagacagcgacagatcatcaggccttagattatcgtaacgagcatgcaacctaggtccctcgcatgcacggttcacagcagggtttgcgctcctgtgagaatctaatgctcccgctgatctgacaggaggtggagctcagatggtaatgtgagcaatggggaggggctgtaaatacagatgaagcttcgctccctcacccactgcttacctcccactgttcagccagttcctaacaggccacggaccagtgctcgtttgggtactggtttggggaccctttctttaggggactgctgtgtgtcatctgaatcatcagcagtcagacctgtcttgttttcccatccagatagccaccatcctggactgccatgcagccaccctgcagcggaaggctgatcgagaggtcttcttcatcaacacccagagcatcgtgcagttggtccagaggtgaatcctgggtctccccgtaggatgtggttgtcacctgaatcgtcgcatgcattgcaccagggtggtgctctggggctgtcttcagggcaggcttgaactgagagaaagtgtgttatagtcctgcagtgccattactaacagcagaaccctgggtgaggtactttacttctgtaaatctctgtttgtaaatctcagctcactgcaacctccgcctcccaggttcaagcaattctcctgcctcagcctcccgaatagctgggattacgggcatgtgccaccatgcctggctaattcttgtacttttagtagagacggtgtttcaccatgttggccaggctggtctcgaactcctgacctcaagtgatccattctcctcgacctcccaaagtgctgggattacaggcctgagccaccatgtctggcctataaatgtattaagttttgtgaagtgctgacaaatagtaaatacttgatagatacattagattgagacaatgggatgaaatagctttatgtatgataaaacactgcaaaaattgttattgtggcttttgggacaattgcaaaggaaagtggatgaataattgtatttcatctcaagtagttatttattgtacaggggtttcccgctgcaggactattctgatgacaaaaggattttctttgtttttttgagatggagtttcgctctgtcggccaggctggagtgtaatggttcgatcttggctcactgcaagctccgcctcccgggttcacgccattcttctgctgcctcagcctcccgagtagctggaactacgggcgcccaacaccacgcccggctaatttttttgtgtgtttttagcagagatggagtttcatcatgttagccaggatggtctcaatctcctgacctcgtgatccccctgcctcggcctcccaaagtgctgggattacaggtgtgagccactgcacccggctgacaaaaggattttctgccacttttcatgaaaaatccacctagcaagaaggctttccttatgaagacaatcagggccaggcgctgtggcttatgcctgtaatcccagaattttgggaggccaaggcaagaggatcacttgaggccaggagttggagaccagcctgggtgatgtagcgagaccctgtctctacaaaaaaaaaagaaaaaaaaaatgagtcggggatggtggtgtgtacctataggcccagctactcaggaggctgaggtgagaggactgcttgagcccaggagttcgaggttatagtgagctgtgatcgcgccattgcactccagcctggggacagagcaagaccttgtcttttatgaaaaagaaaaaaggaatcaaagcattcttggatttgaaccagtaaattccaggcatgtttcccatgtgccagaaactcacaggtacaaagaatgtgagattgtagaaaactggcctccttttcaaggagctcctcagctgttagggagagagattttagtgtggattccccacaaactgcaagtttcacagccaagggctaggaagggagtcctcctaaaacacatagactgctaaccttaagcccatcctttaagcttcagagaaacatctaggaaaaatgaaccattaataaattaactgaattttctagcaagttttctgtgctgaccataaatattaaagccctgtcctgtattgtgtaagtatgttttaaaatcacatttgtatcagagtcttttagcatcttggtctgttttgttgtgatttggtgatgctgccatgaagcgtctacttccccacaactcagtggcgcatctcctgagaaacttgactcctgtgttcagatttttggaagaacatccaggttaaaactttgttttaaaagaagcggctaggtgcgatggctcacacctataatcccagcactttgggaggccaaggcggatggattgcttgagctcagaggttcgagaccagcctgggcaatatggtgaaaccctgtctacaaaatatacaaaaattagccaggcttggtggtggccacctgtggtcccagctactccagaggctgaggtgagaggattgcttgagcccgggaggcagagattacagtgagctgtgattgcaccactgcactccagcctgggtggcagaacaaaacctcgtctcaaaaaaaagaaaaaaaaaaagggagaagcaaaatttacatggggatcttttggtaaatgtttttccagtttgtctttttaaaatggtctctataccttgggtaagtaattgaaaaattttgtttttaacagttaaagcttgctaaaattggctacccctgttcagtatccgaaatctatgaagttttttttttttcttaactctgtggccagaaaggcgccctcccaagtataaggcttgggatctacctactccagttttgcctccagtttgatgtgggactttgggcagggcagtgttctttttggcctgcagatgaatcaactccatatcctttgaaggcctcaggattagagggtgcctctagatactttaaaaaaatttttggctgggcgcggtggctcatgcctgtaatcccagcactttgggaggccaagacagccggatcatgaggtcaggagatcgagaccatcctggctaacacggtgaaaccccgtctctactaaaaatacaaaaaaattagccgagcgtgggtggcaggcgcctgtagtcccagctactcgggaggctgaggcaggagaatggcgtgaacccgggaggtggagcttgcagtgagccgagaatcgtgccaccgcactccagcctggccgactgagcgagactctgtttcaaaaaaaaaaatgtatttttaaattaactaattaattaatttttatttatttattttgagacaagctgtcacccaggctggagtgcagcagtgcaatcatagctcacaacagccttgacctcctgggctcaagcgatcctatcacctcagcctcctatgtagctaggaccacagtcatgcgctaccactcccggctaatttttttgatttttttgtaaagacaaggtctcaccttgttgcccaggctgctcttgaacttctgagctcaaatgatactcacgcctcagcctcccaaagtgctgggattattggtgtgagccaccatgcctggccttaatttttttgttttgttttgtagatatggggtcttggctatattgcccaggcttgaactcctgggctccagtgatcctcccacctcagtgtcctttctaaaatcctttctctctctctcttttttttttttttttttttgagacggagtcttgctctgtcgcccaggctggagtgcagtggtgcgatctcggctcactgcaacctcctcttcccggattcaagctattctcatgcctcagcctcctgagtagctgggactaccggcgcgtgccaccatgcccagctagtttttgtatttttagtagagacagggtttcaccattttggccaggctggtctcgatctcttgacctcgtgatctgcctgcctcggcctcccaaagtgctgggattacaggcatgagccaccatgcccagccaatcctttctctttttaaaaatcataaaaaaaaatactaaatattcaggtactcaaggaagggtgtgagcattaagagcagccttcccttctccccagataccgcagcgggatccgcggctatatgaaaacagtggtgttggatctcctgagaagatacttgcgtgttgagcaccattttcagcaaggcaagagatgctgatgccaacaccagtgggatggtggggggcgtgaggagcctgagctttacctctgtgtggtgttttgtctcccccagcccactacgacaagtgtgtgataaacctcagggagcagttcaagccagacatgtcccaggtgctggactgcatcttctcccacgcacaggtggccaagaagaaccagctggtgatcatgttgatcgtaagcaggaagagggcctgttactagactgggggtgggtcaggagtccacaaacgttttcttaaaagggccagaaagtggctgggtgcggtggctcatgcctgtaatcccatcactttgggaggctgaggcgggcagatcacttgaggttaggagtttgagaccagcctggctaacatagtgaaacctcgtctccactaaaaatacaaaaattagctggccatggtggtgcatacctgtaatcccagctacttgggaggctgaagcagaaggatcgcttgaaccctgaaggcagaggttgcagtgagccgagattgtgccattgcactccagcctgggcaacagggtgagattctgtctcaaaaaataaataaaagaaaaagtaagccagcaagtaaattttttagactttgcaggttggtgtggtctctgtcgtgaccactcaacactgcctttgtacaatgtaagggaatgggcatggctgtgttcccataaaactttgttgggagcccgaggtgggaggatcacttgagcctaggagttcaagtccagcctaggcaacattgcaagactccatttcttagaaaaaaaattaaaactgggcactgtggctcacatctgtaatcccagcactttgggtggctgaggcaggagaatcactcgaggccaggagtttgagacgagcctgggcaacatagggagacccccatctctacaaaaagtacaaaaattagccaggtgtggtggtgtgcacctgtagtcccagctactcagggggctgaggcaggaggattgcttgagcctgggatgttgaggctgcagtaagctgtgatcacaccactacactccagcctgggtgacagaatgagatcctgtctcaaaaaacaacaaaaaaaatcccaactttgtatacaaaaacaggcaatgagtcgggtttgttggcactgggaagatcatgactaatgcaaagcacctagtttgtgccaggtactcctgaagtgctttccaaataaatagttgctcatttaattcacgcagcagtcctagaaagtgggtactgctgtcacagctctttggcagagcacagagaggttaagccacttgcccaagggcacccagctcctaaatgtagagccaggatttgaaccaatagtctgactccagactcatgaactattagccgcaggatattggattttgagtcctgtgtgtggagaagaagaaatatggagtctctgttcttgtttctctttccactcgatgatagcagtcttttgttttttgtctgttttttcttttgagacagggtctcgctctgttgcccaggctggagtgcagtggtgccatcatggctcactgtagcctctatcccctgggcttaagccatcctcccacctcagcctcccaagtagctgggattacagactcacaccaccacgcccagctagtttgtttgtttgtttgtttgtttgtttgtttgttttgtagagatgaggtctcactatgtttcccagtcttgtctcgaactcccgcgctcaagcaatcctcctgccttggcctcccaaagtgctgggattacaggcataagccactgcgcctggccgataatagcagtcttttataactaaaaatatttttctttgatatgtcccttgcaactgacttggaaaatgtaggatcagcagagtaagagcaacttggacttggcttatagtagaaaggggtttggcaatttttttttttttttttttgagatggagtcttgctctgtcgcccaggctggggtgcaatggcataatcttggctcactgcaacctccgcctcccgggttctatctatcttctatctatctttttttttttttttgaggcagagtctcactctatcccccaggctggagtgcagtggcacgatctctgttcactgcaacctccacctccagggttcaagcaattctcctgtctcagcctcgtttagctgggattacaggcatgcgccaccacgcccggctaatttttgtgtttttagtagagacgtggtttcaccatgttagccaggctggtcttgaattcctgacctcaggtgatccaccagcctcggcctcccaaagtgctgggattatagacatgagccaccacgcccggcctggcaacttttttttgtaaagggctccagatagtaaagattttaggcttgaggacgtccaccccctattgccactactcagctctgtgagctctgccactgtagcctgaaaactagacaataggtacatgaatgagggtggctatgttccaataaaactttatttacaaaaacagtcagtaggcagagtttggccacgatctcagagaatagttaataccctgtcccctgtccaagttgcattaataaatattgggatttttggtaaagaatcatttaaaaatctcacgcagcagcttttaatcctggctgtacattagaatcacctagggggtggggagacttaaaaaatacaattgcccatgccccacccttggtcaatttaatcagagtttctaggggtagggcccaggcattagtgctttttgaaagtttccctgtgggaaacctaaatgtgcactgtatattagataatattattggtttaatgttcagtttctttggtgttttaatggttctgtagtaggtggaagggagatatgtgcgaaaatagtgtaaaggattgtggtgtctgcaactgactttcagaaaaagagagagtgtgtatgtgtatgcgcacgtacgttcttattagagaaaaatcaaatatgataatgtggcaaaagttttaacaattagtgaatctaggtgattactatgggtttttaacatactgatcttcaattcttctgtagttttgaagtttgtaaaaattaattgggagagaggactctccaagtgattgcaacacgcagccaggactgggaatttatgcccaaggagatatccactctttggggggagttctattactaaaataatataatgtttttcaaaatacattctttggatggagtttcctggagtttgagtgtttgtcaagcaaaatatgcctgtaatctattacagtcagcttgccattcaaaggcagtgggtctgtgggttattttgctgttcgttcttctgtgcacatattgactctcttctgggcatgaagtcatgaaatatcatgtacaccagaggacagccaagggaagatgggtggagcagcccccagttcttgggaattgggacattttcctggacctccttggtgatagaggctaaaaatgttgaaccaattacagtctcgggataaatgtgagattcattattcttctgactttcttggtcccatttgttagaaaatagtgagttctctgcacctgatggtatttggtacctgagaggttttgaacaaagacttgtgaattgaatgattatttcgaaatgaatttttttgaggcttttaaagggacctagtttctgacaccagttcactggtcatgggacttcgttagtgacaaaacgaagcaaacaaaacatgattctgagaactaaaatatacaagatgagactgcttcacaaagttaacaagaaagaaaaatggtgttgttgttgttgttgttgttgtttgtttgttttcgagacagagtcttgctctgtcacccaggttggagtgcagtggcgcaatctcggctcactacaacctctgcctcctgggttcaagtgattctcctgcctcagcctcccgagtagctgggactacaggcacgtaccaccacacctgactaatttttttgtagttttagtaggaaacagggttttgccatgttggccaggctggtcttgaactcttggcctcagatgatttgtccgccttggcctcccaaagtgcagggattacaggcctgagccaccatgccctgcctagaaaaatgtttttgttattattattattatcttttgtatgtagaaggcaatggttagattttttaacattcacacttagatgtgtggggggaaatttaaaaaatgttcacacaaactcttgagtttttcacctcttagaaaagcaccagtctagctgctggccagcacctgtgctgtctggcctgggagccacatgcctaggggattggtggggagttatgccaccaccgtttaataatagaaagcaaatcagagaagggagaggagatttagaacactttcctaccacatttcttcagcattgatgttcctgtgtctttgtgtatgaaatatcaatatgttgaagttttttctgatgataaaatcagtctcggttcattataataggaaaatgcagaaacacatgtagaaaaaaatgccccacagctctaccatctggtgacctcttgaagaccagtcttagtggatgcccggggtggggaatgggggcatattgctcaggagctctgatatttagcattcattgctccatcttcagtgggtggttagggagcacctgcgctgagctgttcccaagccccatatgcacttagggcataagaggagatgcgaacaccggctgcacccaggcctggtctccagcagaaaggcccttctttcagaagcagagaggagggatgcaacacagacacattgtccctccctctcctgcaagattcaaccccacgtccctctcctctgaaaccgtgagcgccttaagtcaggcagcaatgtgtaggggaaggagcgggaggctttgggggcagaatagtgctgtgttcgaatctggctctgtcttgcacatgtttgctggctttggggtgaggcatattgcctctttgagcctcagtgttcctatctgtaaaatgggaatcaaaataagtaactcttcgtgggggtgggagaatttggggagttgtatataaagggtctagctgtttactagccacctggcacatagtatgtgcctgataatcactgacctttttttttttttttgggggggagacagagtctggctctgttgcccaggctggagtacagtggtgcgatctcagctcactgcaacctccacctcccaagggatgatcaaatcatcctcccacctcagccttctgagtagctgggactacaggcatgtgccaccatgcccggctaatttttctatttttttttttgtagagacaaggttttgcgctgttgcccaggctggtctcaaactcctgagctcaagcgatcctcctgcctcagccacccaaagtgctgggattataggtgtgagccaccatgcctggcctaatcactggctattaatagtaacgtaggcagggacttagttgtatttgtttgttcttaccaggcatttagggcatgttgtggggtggatgaatgggtggccgagtgagtgagtgagtgagtgaatgaatgactgactggggtgggtgcacagtagaaagtggtgagggtttgcataacaggctgtgctgggcctgtttggagagtggagcagccgcctggcttttgcggcaggtgctccccaagtcgagatgagtgctgcatgtttccctgggctggagaaaagccatttggcttctttttctgtcccctaaggatgagctgtgtggcccagacccttccctgtcggacgagctgatctccatcctcaacgagctcactcagctgagcaaaagcgagcactgcaaagtggccctcagagcccggcaggtagggtctcagggtgcggtccccacgatgtgcgtttccccccaccctcctatgtgtcccctaccgtgctcagccctcaccatgcacagtcccaccgtgctgccggcccgtgcccgagcctctgccttctgccctgggaggttggctcacgccagcgcccccatccctccccctgcagatcctgattgcctcccacctcccctcctacgagctgcggcataaccaggtggagtccattttcctgtctgccattgacatgtacggccaccagttctgccccgagaacctcaaggtgagcccgtctccttcctttcaccatctgcagagcacacactgtggcccaggtgggggcctctggggaaacggctcctcctgccctccaggtgctcagtggggtgcagggcacagccacagatgcagacagttcagcccaatgtggccagggctgcccgaggggtcacctggggagactctaggagaggtgggcatggagcccagtcctccaggaaggacagtgtgacagcagtgggggctcacctggtgcagtttacaaacctcagccatatggagcatatctggaagctgtgagccctcctgtggctgagtcgcggcctcatcttccctattcctggactctggctcatttacatgttctcaggtaccccctcagtgcctgatgggagacctgtcccaggtgccgtcatcccggagttcttcaccagctctcctatgattaaataggggaggagcccagcgcgctgcagggcactgatcgcttttagtggtcaaagcatgacttctgcctgctcccaccgcccccactcatcagactggtgattaaaaaacttactcactggctgggcacggtggctcatgcctgtaatcccagcactcgggaggccaagactggaggatcacttaagcccaggaatttgaggccagcctgggcaacatgtgagaccctgtctctacaaaaaatagacacacaaaaaaaagagccacgatgttggcgcacgctgtagtcccagctgctcaagaggttgaggtggggagatcgcttcagcctgggagtttgaggctgcggtgagctatgatcacaccactgcactccagtttatctcaaataaaaacaaagaaaaacctgaaacttgttcacatttacttttccttgtttccccttttcatttcccttagaaattaatactttcggaaacaaccatcttcgacgtcctgcctactttcttctatcacgcaaacaaagtcgtgtgcatggcgtccttggaggtaagcaggagaggcccagagaacagcactgaccatgccagttctagtgttcactgccgctaccatgcacctgaccctaggccacatgccttggtgaatgtgatcctatccttttctcttcaaggtagctatgttaatagtcccatcttacagaggaaggaactgaggctcagagaggtcaagtgacttatgcaacgtcacacagctagaaagtggcagaaccaggttttgcattattgggtctgcctcattccagattccatgctagttaccactgctgtctcatgtcattccagcctcttccaggcagggcacattaaatactaatccctgagagccaagtctgaggcacctcatctaaactttctgactcacgtgcattaaatacctttgaaagacttttctgcttggaactgccagagctagaggagcccaggtgacaacttaaggtgaccccctgccccccgagtgatgaggtagaagggcgtggccagtagcaaaacccagattagagccaggtgatcccaggtggtcttgctcccgggagcaagaattcaggtcttcttgaattcaggaaccaagaagtgttgtgttggttccaggaaatcagagttttaaatctgctcttttattattattattattattattttgagactcgcttgtgcctagggtggagtgcagtggcactatctcggctcactgcagcctctgcctcctgggttcaaatgattctccttcctcagcctccccagtagctgggcctacaggcgcccaccaccacacctggctaatttttgtattgttagtagagacagggtttcaccatgttggccaggctggtctggaactcctgacctcaagtgatctgcctgcctcagcctcccaataaatctgctgcccttttagaatctttttaagaaaatatgtttttaacacggccctcttacccgggtctgctttgctggcagtagtttttccaatattctttatcttctgagctcagagtctcagtcccctgttgcccccactttctcttctgcatccttgggagcctgtgagtcacacagtgagaaggtttactgggtcttctggagaccatcttgggcttgttagcatattacagccacagggtctcctgggcctgcaacttttattcctctatgggtttcacctctggaagaatctttctcaggcctcactctttgtttctaacagggagacctaatacacctcttctgtagttactttaaacacaatttttgttttgttagagacaggtcttgccgtgttgaccaggctggacttgaactgctacgctcaagcgatcctcctgcctcaccctccccagtagcttggactacaggtgcatgccaccatgcttgacttacagttactttttaaagtgctaaatgctgtttgtgtcaattagagatttttctaggatgcttttgggtttttttatttgttttgtttttccaccacgcccagctaatttttgtatatttagtagagatggggttttgccatgtcatccaggctggcctggaattcctgggctcacgcgatccacctgccttggctccccagagtgctgggattacaggcgtgtgccaccatgcctgaccccattcttgacagggaatggtgggaaccttccccaaattcaagttccccagtgctggccaagggcaagtcttttaatggaaagcaattatgtctgctaattgctgtattagctcctgctgcccagttcccgcatttcctgttcagttgaaaagcttccagtgtttaaactccagaactgcattgtccactatggcagccaccagccacgtgtggttagtgagcacttgaactgcatccagtctaaatcgagctgtgctctaagtggaaaatacacactccattccaaagatgtagtactgtatggagaaaagaatgtaaaccatctcaataatttcttatattgattacatgttgaaatgataatatttgcatatgtggggtgaaataaaatatattattaaaattattttttatcttttttctaagtggttactagaaaatttaaaattataggccaggtgaggtggctcatgcctgtaatcccagctctttaggaggctgaggtgggagaatcactgaactcaggagttgcagaccagcctgggcaacataggaagatcctttctttactaaatataaaaaacaaaaaaaattagccaggtgtggtggtgcctgtagtcccagctacttgggaggctgaagtgggaggatcctttgagctcaggagttcaaggctgcagtgggttatgatctcaccactgtactccagcctgggtgatggagtgagaccctgtctcaaaagtaaataaataaaataaagttacatacacagcttgtgttatatttctgttggacagcactgctctaaagcagggtttgataaactatagaccatggaccatatttggcccaccacctgtttctgtaaagttttatcagaacgcggccaggtacggtggctcatgcctgtaatcccagcactttgggaggccaaggcgggcggatcacctgaggtcgggagtttgagaccagactgaccaacatggagaaaccccgtctctactaaaaatacaaaattagccaggcatggtggtgcatgcctgtaatcccagctactcaggaggctgaggcaggagaatcgcttgaacctgggaggaggaggttgtggtgagctgagatcatgccattgcactccagcctgggcaacaagaacaaaactccatctcaaaaaaaaaaaaaaaaaaaagaagaatgcagccacacccattcatttacatgttgtccacagctacgtccgtgctaacagcagaattgagtagttgcagccaagatgatatgtcccacaaagcctaaaatatttactacctatctcttacagaagtttatcaacccctgctctagagtttagagtggattttgtgtaactagtaacactctgaaatatgagcaaatttgctcttaactgctgcttagaaatctttttttttttttaattgaggaaggatttttctctgttgcccaggctgaagtgcagtggtgctatcatagctcattgcagcctcaacatcctgtgctcaagcaatcctcccacctcagcctcccgagtagctgggactacaggcgcctgccaccatgcctggctagtttttgtatttttagtagacatggggatttgccatgttgcccagactggtctcgaactcctgggttcgagtgacctacctgccctggccttccaaaatgctggattgcaggcctgagccactgcacccggcctgcttacagatagatattttagaggtcatttctggtacctgttccccgtgagtgccctcagcttttgagcacactctgcagtggcccctgagagaatgtccgtgtgtttctgccttgtcaggtttacgtgcggaggggctacatcgcctatgagttaaacagcctgcagcaccggcagctcccggacggcacctgcgtggtagaattccagttcatgctgccgtcctcccacccaaaccggtatggagtgggacacacccagggacggcctgtgtttctgttcttcctgacctctgtcgtcctgtctctggaaggacctggcaagtgtgtttgggcacgctgctggggagacatcagcgataagcacttcccctgtgggagctccctgcagcgccattttctcccctctaacatggtgataatgcagagcccacctcctacacctgcactgttcagtacagtagccatgtgtgcctatttacattaaaatgaatgcacatgggccaggcgcggtggctcatgcctgtaatcccagcactttggggggccgaggcgggcagatcacttgaggtcaggagttccagaccagcctggccaacatggtgaaaccccatctctactaaaaatacaaaaattagccgggcgtggtggcacatgcctgtaatcccagctactggggaggctgaggcaggaggatcacttgaacccgggaggcagagtgagtcagtgagctgagattgccccactgcactccagcctgggcgaagaagcgagactccgtctcaaaaaaaaaaaaaaaaagaggccaaacacagtagtggctcacacctgtaatctcagcactttgggaggctgaggtgggtggatcacaaggtcaggggttcgagaccagcctggccaacatggtgaaaccctatctctactaaaaaaaatacaaaaattagcctggcatggtggtgtgcactggtaatcccaggtacccgggaggctgagggagaactgctcgaacccgggaggcagaggttgcagtgagctgagattgcaccactacacgccagcctgggtgacagagcaagagtccatctcaaaaaaaaaaaagagaaaaaacaaagaatgcaaatgagccagccatggtggcccacacctgtaatcctagcacttcggagggctgaagggggcagatcaggaacttgaggcctggagtttgacaccagcccggccaacttggtgaaaccccatctctactaaaaatataaaaatttgccaggcgtggtggcacacccctgtaatcccaggttactcgggaggctgagggatgagaatctcttaaacctgggaggcagaggttgcagtgagccaagattgtgccactgcactccagcctgggtgacagagcgaaactctgtctcaaaaaaaaaaaaaaaaaaaattcagcttctcagtcatactgggtggctcatggctgccatattatttgacagtggagttctagaacattctgtcatggtagaaagttctagtagacaatgccacccaagccattgggaagagtcatgagataaggcacatgtagcattttagacagtgcctggcacaaaggaagttgttgactgtaagtgatcccggagatgatcatgactaacgctgttattaccatctagtggcatgccattggcctgggcactctgctcagtgctcccacactcttttatttatttattttttttgagatggagtctcgctctgttgcccaggctggagtgccagtggcacaatctcagctcccagattcaagcgattctcctgcctcagcctcccgagtagctgggactacaggcgcacaccaccatgctcggctaatttttatatttttagtagagatggggtttcatcatgtcagccaggctgatcttgaatgcctgacctcagatgatccacccgccttggcctcccaaagtgctgggattacaggcgtgagccaccgtgcccagcccacactcttattttattcagctcttatcctctatcggccaaaaatgtgttctcatcctcgttttacagatgggagccctgggccctcacctgacctaggctgagctgcttgtgcacgtggagtgggaatttgagcccaggccacactctcacctccaagtcctttccacagcattcaggggccctctgagccaggtgtgagggcacctgtcctgtctgtgtccactgtagtctgctgtccaagagctgtagttcagtagataccctcagtgttctcacctgagaatatctttttttgatttttttgagatggagtctcactctgtcacccaggctggagtgcaacggcgcgatctcagctcactgcagcctccgcctcctgggttcaagcgattctcctgcctcagcctcctgagtagctgggaccacagtcatgcaccaccaagccccactacttttttttgtaattttagtagagatggggtttcactgcattgaccaggttggtctggaactcctaacctcaaatgatctgtccacctcagcctcccaaagtgatgggatgacaggcgccaccatgcctggctcacctaaaaatatctgatgtgtctgagttcctcactcacagtctttttttcagtccatcttgtttcaggacccaaagtattaataccatttaggtcaggtagagtgggataccttctcttaaagtaattatgtctccttgggattcgaagtgttctctctcacgctccctcacccctctggttttagttcttatgggggtgcccaaggccttacctacggcggcattgatgtcattgtgatttgggagttcggttgatcagatctgtacaggcaatagggttcatgctttggtgaagcggggatttttctggcctcttaggatttttaaaataactttcttttcctgttggttttaagaagaaagatgctgctatgttttggatgaagaaaagggggcttccccacgaggcactgcctttcctagttatttgtttttacccttcttatttccaaaaataggattgtgacattttaccccattgagagaaaggggactgactgcttgcagcctggggtcattctggggatttggagagcagtggtggtgtaagatattttgtagctgtctactcctgagaaggactcttttgatttttttgtttggttgtttagagacagagtctagttctgtcacccaggctagagtgcagtggtgtgatcatagctcactacagccttgaactcctgggctcatgtgatcctcccacctcagctccctgtgtagctgggaccacaggcttgcgccaccacacctggctaattctttaaaaatatttttttgcagagatgggggtctcactatgtggcccaggttggtcttgaactcctgggttcaagtgatcctcctgcctcggcctcccaaagtgctgatattataggcgcgagcccctgtgcctggccttctcttttgatcttattgtcccagcaagtcagccctgttaggaagggaagggcggctctcctgagggctgtgggtcatgccttgtgagctacacgtatatccaggttattggttgtgattttcagtatgggcacagggtccttttttgacccagagagacattgaggaccctgggggattcctggccatctaagattctcatgattgctctcagtgccagaaatgtactctgggcctgtgaagagaccttgcctgcggctgcccccaccaaccagccctttaatgcctctgtaaagggccatgaggaataaagtctatccccaagatggcctggcttggccctcaacacttgtgtgtgtagagccaggcacatggtgctttaggtcaccgagacccaagggaaggtcagatgagaagttggcagggctttgtgccagctgcagcctggacctggacctctgtgctgggtgggaactggctacatccccctgcgatggggctgctgtcctagctctgcccactgttgccctgcaggaaactgaccatcacaaccagacttctccatgattttttccagcagaagcaggaaatctatttttttttaacctgaagtccttccatttttcaatggggacaggtaattcatgttaaatgaatacatgaacacatgttaattcatgtatgttattaaaatgctgcatggaccaaagtcattctgtgagtggcattcagccacactgccactgcaagtttgtgacccctggattgagctgtcggggagcagaggggccatgatcgtgatttcagagcacccaacaggaatgcacacacctgtgtcagggtccccaaaagcacccccaggttcgatcatcgcctaggagaactcacaggtctcgggacatagtcatgcttatagctctgacttattagggggcaaggatacaaagcagttagccaaggcagaaggcatcagggtgaagtccagaggaaagcaggtgtgctgccagggtcctctcccagtggattcacgcagggtgcacttcattcccccagcaaggagttgtgacaacacaagtgaagggttgtcttccagccccgcaccagggattggtggctggtcacatcaccctctgctctgcatcgaaatctcaggcttgcagaagaaagcaggtgttcagcataaaccacactgtttgtgcaaacagttgaggcacagtgagccccccttgtcaccttcagggaacgataggaaccttccccaagtccaagttcccagaggccagccaagggctgtccttgcaagcaagcaggtctcctttctcagaagagcagtgtggggcctgctgtgctgacttcctgcacaccatttcattacccctcccgtatctgattccaaggcccaattctaacaacctcaggtggcccattgagatttgctgctggtgagcagccagttctgggagcatcgttgtctaaactccagaaggctgctgactttgtcccaagggcaagtttgatggagggattacagggagcagaggactggagtgtccgtcaggaccaagcctgactgcctcaccagctgcctggggctggtggatttctccaggagaaattgatgctgggagtgtttcttctctgtggtcaagttcagcacttggggctcccctcgggactgtgttgagactggactctcatgcatgaatcattgattcctacacttgttgagctcttactcttcaccaggtcctgagggatcagatgagaccctcctcaggccccggccccagccattgtctcatcccctgcccattttaagcccccatttggaagagctctaaatctggtccagctcactgaagcttcaggagtaggagcagctcgtagagttgggtctgcaagcagctgcctcatccccgacttgccatcaccttacaggatgaccgtgcccatcagcatcaccaaccctgacctgctgaggcacagcacagagctcttcatggacagcggcttctccccactgtgccagcgcatgggagccatggtagccttcaggagattcgaggacttcaccaggtacccagcatggcccggtctccaacaccctgagcatgggggctgggcagacttcccttgaatccccccccaattcactggacagatggggtgggagagacccagacacgtggcacagcatgtcaataacaacagaataataatagcattgtagccaagagtatgagcctacatgtcagcttgcctggcacagcacatcaataacaacagaataataagagcatcgtagccaagagtgtgagcctgcgtgtcagcttgcctggtttgaattctggctatgtgctttctaactaagagactgagcaaaatatttttacctctccataccttcgttttcttatctgtaaaatgggaataataaaggactcacttcataggtgcgccatgagaattaaatgagataacatatgtgaaataacatatttaaagtataattagtatgcagataatatagtgactaaatgttagctctcaatagttactgttatagtcttttttcagcctttcactgtgtgttctgctttgtgcttggagtatcttgtggaattttcacaacagcctcatgaggcatagggattactcttattacctttctttgactcggggtgaggtgaggtttctaggatctcccagccagtaaaaatgggagccaagagttgatctcaagcccagctgatgcctgaaagcgctggaatccttccctgtattcctgatcacagatcacttaggttcattcttcccttttgggaaggaccccatcacgggtgctctggacaaagtagacagggaacctcctgagctctgtagagttggataagatcaaagggtgttggctgggaaattgggagggtctggcgttccctgctgcctggcttggaagcttgacctcatccccatgggtcagcagcccctcagccctccctctctacccgcacccccagaaattttgatgaagtcatctcttgcttcgccaacgtgcccaaagacacccccctcttcagcgaggcccgcacctccctatactccgaggatgactgcaaggtaagcgtctaagcccagggagcaacctggggagcaggtgggccgtggcccccaggctttccagccctaccccttgcttctccctctcagagcctcagagaagagcccatccacattctgaatgtgtccatccagtgtgcagaccacctggaggatgaggcactggtgccgattttacggacattcgtacagtccaaggtactctgggcgtgcctctggttttggtgggggttcttggagaaggaggaggggctgggctcgtcgaggcggcccttggggaggcaggcgtgctgagtacttcagagccacagacctggcttcccactctagctctgctcgcctcatagctggcgaccttgggcagatgtggctgaacgtggggtcagcatttctctcgctcacggtgttgcaatgattcaatgacaaagtatatacacggcttagccagtcccaggtacggagggcacacccaataaatagtttggagattttctgggagtgtttttgttggaataatccagaaactggcagttttaaaatggctacttacattgatgaccaagtgtgccaataacagcaggttgctctgtaagcctgtgatgccattgtatttcagcctgggggacagagcgagaccctgtctcaaaaaaaattatatatatttacagtatacaatgtgatattttttaattatctttttaataacagctttattgagacatcattgacatactacacaattcacccatttaaagtgtgcagttttgcagccataaaaaagaatgagatcatgtcctttgcggggacatggatgaagctggaagccatcatcctcagcaaactaacacaagaacagaaaaccaaacaccgcatgtgctcactcataagtgggagctgaacattgagaacacatgggcagagggagggtaacaacgcacaccggggcctgtcggggggtgggggccgaggggagggaacttagaggacaggtcggtaggtgcagcaaaccaccatggcacatatatacctgtgtaacaagcctgcacgttctgcacatgtatcctgtttttttttttagaagaaataagaaaaaaagtgtacaatttaatatatttttagtatattcaccaggttgtacaaccatcaccagaatcaattttaggacattctcatcactccatagaaaaaccctgtacctgttagcagtcactcccctctgtccccaacccaaaaaccctctccccaccacagccctaggcaaccactaatctactttctctctatatagatttgcctattctggacgtttcatataaatggaatcagatcacaggaggtctcttatgattgacatcttccacttagcataatgtttacaggttcatccgtgtggtaacatgcagcaatacttcagttccttttacggccaaataatattccattgtgtctttggtttttaatgcagaaaaatatccttgtggattatggactccgacgaatcacattcttgattgcccaagaggttagttcacagttcatctctatgagtctttcccattctccaagccttggtgtgtgccatttatttgatatttattttgtagatttgggtgaaagagatcattagaaaggagaaggatttccaaatgattcattctagaagtgaatgtaatcgtttacaatcactaaataaggatgtacatatttcagtgcgtcttgcttgatttaattgtcttgtgtgtggatttctttttgcagaaagaatttcccaagtttttcacattcagagcaagagatgaggtatggccaaaagtaatgatgttttctcttctctagcatcttgttttattttttaagagatgggatggggccgggtgtggtggctcaagcccgtaatcctagcactttgggaggctgaggcaggaggtttgcttgagctcaggagttctagaccagcctgggttatatagtgagaccctgtctctacaaaaaaattaaaaaatcagcctggcattgtgatgcaagcctgtggtcccagctacttgggaggctgaggtgggaggattgcttgaacctgggaaatagaggtttcagtgagccaaggtgattccactgcactctagcctgggtgacagagtgagactctgtctcaaaaaaaaggaaaaaaaagagatggggtctcactatgttgcccaggctggactcgaacttatggctcaagcgattctcttgcttcagcctcccgaatagctgggactataggcacatgccaccgtgcctcccagctccctggcatctttgatattcatgaagaatatagtctgcagtccttaaggcatccccatattcaagaatgtagcaacttttgtgtagactgcagtcttcctctgggattgtatttccattgagagccctctgttccctgcatggcactcagacctgagaatcttgccctttcagcctcactacaggtttctgtcttgcttgaataattttcagtacttgctgatgtactcagtaagacattttttccaaactgtttttcttatgctcgtctagaacagtggttggcaaactcacttgcagaccagctgcctgtttttacgaataaagttttattggaacacagccacacccgttggattccacattgtctactctggctttcactctaacagtagcagaattgagtagttgtgacagagcccgtatgatccatcagcctaaaacatttactctctggccatttaagaaaacgtttaccgatccctgttgtagaacaggtaggtttattcccagcactgattcaagaccccaccaaattcagcattttgcattttaatttatccaaagctttatttttctagctaagacacatccttttcttaatgtcttcattttttttttcagtttagtttccagtactgtcagttgctttcttttcggggaccaatttccaccaagaaaccaggggttagtggcttcatgagaattgccacaggctgtgacagatggagaacagcctggtcacgctggcaggtgatagggactagctaggttcccccaggagccagcgctgcacccagcacaacaggcttgcaatgcccatagctctcctcagatcttagcaaaaccccaaatatctggagccctgggggtagcttacaattagggaacatcatgaatgctgcattcctgagtgccaaacccatggacaccaggggtctgcagagtagggtgtggaccaagcagggacgcagctccaacgtcacgctgtgtgtgtatgtgtctgtcttctctctctggtccgcctacagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggtaagatgtcgcagagcatttcttcctctctcagaacctggccctcccttccttacattcctgctctgtgctgggtcctgggctgcatgctggggatggagagtacaccaacacccagggtcctgcccttgctatgctccagtccagggcaggaggcggacagcaaagtggcctgtgatcacgtccaggctggtggcacttggatctgtttcttgtattatgtgggtctctgcgcatgagaagaaaatttccaggatagaaaaatactggtttgttcagggaatttcttaatatttgctgactgagtgatcgttttccattgtttcttgcatttagaaaagtaatccatggccgggtgcagtgacccatgcctgtaatcccagtactttgggaggctgaggtgggcggatcacttgaggtcaggggttcaaaaccagcctggccaacatggtgaaaccctgtgtctactaaaaatacaaaaattacctgggcgtggtggcgtacacctgtaattccagctactcaggaggccgaggcatgagaatcgcttgaacctgagaggcggaggttgcagtgagctgagatggagcccttgtacttcagcctgggggatagagtgagaccctatcacaaaaaaaaaaaaaaaagaaaaaaagaaacagaagtaatccatgattatattgtgaaaattttaaataagactgaaaacgatttttaagaacctagcgcaaggaccgagaatcctgtcactgaggggccagcttagttgttgactgtttctagacacaattccgtccctgaaacctagagttgtaggcataagttgcagataagagctgagagtggacagatcatttgaatatattattctttaattggtcagtcacttgtggacctctttcattgttaataaagagtggtccaccacatattatttccttgcatggatgtaccgtgtataattttttttttttttttactaatcccctattgatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatatatatttttttggagatggagttttgctcttgttgcccaggctggagtgcaatggcacaatctcagttcactgcaacctccgcacccccgggttcaaacaattctcctgcctcagccttctgagtagctaggactacaggcacaccccaccatgcccagctaattttgtatttttagtagagatggggtttctccatgttggtcaggctggtctgaaactgccgacctcaggtgatctgcccacttcggcctcccaaagtgctgggattacaggcgtgagccaccacgcctggccctattgatggatattaagctaactgcagtttttttgctacctgtcagctagatgttttatttttattttgatacagagatttgctcttgtcacccaggctggagtgcagtggcgtgatcttggctcactaccacctctgcctcccgggttcaagcgattctcctgcgtcagcttcctaagtagctgggattataggcgcccaccaccatgcccagctaatttttgtatttttagtagagacggagtttcaccatgttggccaggctggtctcgaactcctgacaactgatccacccatctcggcctcccaaagtgctgggattataggcgtgagccactgtgcctggccaagccgttttaataggttttattattgttgaggtatggtgaggccaacagataaggagacaactgccatcaaaaagacagtttattactcatagttcccaagaagaaggggttttccctgccatggggccacatggggaggctctggggttggtcaggcagcagagggacagaggggaagacatggaagacgtggacgagagccttgattgtggtttcctggagaagaaaaaagtgaggctgagtaaacaggtttaggattggctgtgaatcatctcagcagaccctggcatatagaagctgtctctggttctcaggaatctggccctgggtgattagagcaggtggtttgtgtccccaggtatgatccagggtcagcaaggccccaggtgtcaaagtgtcagaatgcagaaaataggacacatgtcaatacactcaacagctttgcagtcccttcgcctctgagaggcagggctctgctgttcttgcctggcacactttttggaggaggggaatgttttcctcctgtctctgcctctttggggctgagtttccagccagctgggagtaggcctgcacccctggcctgagcagctgcccctcccactctttggcaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaaggtctcgcctttgcaggggggctctcaccgggctctgggttcaccctctgagccatgctgctttggggtattgtctcttgccactcaagacctgggttccaggatgaaaccatgcgtatctgagcctcagttgctgcgggaggagagcaaaccttctgccattcaattctagagctatgttttagccatgccctgcacgggaatgctttactttaaggatgacaagcatgctcaaaatgtctttcaaaacaaaattttgtcctttccctggttccaggctgcgctggggactgcatgtgggtggggagagacgtgagaccgtgaggtctgtggctgaatgttccctgtcaggtggctcttcacgagcagacagacttttatggtggtgattctggaatgaaagaagccccacttgtaatcccagtactttgggaggctgaggtgggtagattgcttgagcccaggaatttgagacaagcctgggcaacatggagagaccctatctctactaaaaattttaaaaattaaaaaataaaatattaagattattaatcaaattaatattaatatcgatatattaatattattaaaatatataaatgtattttattttattatttaataatatatattattaaaaataattaatacaatagtattattaaaaagagaagtcctgatacatccgtttggtatctgggggattcaggggacccatgtggaggctctggcctcactagttcaggtagttccagaaggaagcagtgcaatggcttgagtcaaaggcatgtaaagatagtataacatagcagtactagttcagtcacttatcagcctcagtttccttatctgtcagtgagggattagaaaagctcgcctctcttgagtacttacgaaggcaaaatgaggtagagttttaaatgcttagcaagagccgttgcttgttattagttaatactttttgttggatacacactatgtcccaggcgtttttgcagtcagtatatctcatcctcttattagtatcagtgctattgcaaatgtccttgggatgtcttggccctgaaactggaattgctgtgttttggggcagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatgtaaggctggcccgcgccgtgggggtctaagtcaaagcagaagcaggctgcttgggccatcaatttgtagattaagatggcatttggaggcggtcttgccttgctctcccatgtcattctgggttggggtagccccctctgagtgttatgttaaatgtgttagcctttgaatcttggtttttcactcacctaaaaaggagagtgaatctccaagtttaatccattctgtggccatgttggatttttgatagagacaaggtgtcaccatattggccaggctggtctcgaattcctgacttcaagtgatctgcccgcctcgacctccaaagtgctgggattataggcgtgagccaccacgcctggccatatggccatatttgggataagttgtgcactactgtggttgactgtaatgcagtcctcagattggttcacttagggaaatactttcccaaccatgttctaggacagacttttgtaaagtgaattaaatgttcttttgactgccatttaaattcctatgtgtgtacataaaaatatacatatatatacacgccattttttaaagagatattgcctagactgggcctgaactcctgggttcaagcaatcttctggcctcagcctcccaagtagctgggactacaggcacatgccattgtgcctggtctatgcactttttattttggagtaattgaagactgaagactctcaagcagttgcaaaattagtacagaagaaaaaaaatagtgcagaggattttcacccagtttcccccaatggtaatgttgattgaacttcaccattgcacatcattaaaacaggaaattgacattggcacaggactgttcgcaccaacactgaccacgttcggatttcaccagcgtttccatgcatgcctgttgttgggagtgtgtgatgccttgatcactgtatttttggaactgcattccacagcccctgttgtcccttcttgttctggccctccacagtggtgaagaagggagttttacgtagcccaggcactcactttgtcatgccatgtgacatgctttgcttcccccacctgcattttcattgaggactgggcagaaataaattgggggagatgtgtgattctctctcactctctgttttccctcctttctggtccagatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggcaagtccggcggctcagacgcggtaccccctgggtcctcccagcagactccaccagaaccaaagcccatccttaattctccttctaaagacctagtctaaaggacaaggtcttgccaggtgcggtggctcacgcctataatcccagcacttcgggaggccgaggagggaggattgcttgagcccaggagttgaagaaccccatctctacaaaatatacaaaaattaaccgggcgtggtggcgcatgcctgtagtcccagctacttgaaggctgaggcaggaaggatcacctgagcctgggaggtcgaggctgcagtgagccatgatgtcaccactgcactccaggctgggtgaccgagtgagaccccgtcttcaaaaaaaaagaacaaggtctgcattgaagaaaaagaaatgaatgtgttgagaacgacttcatagtatttttctccaaataagactaatttatcccaatgataaaagtcataggatatagaaacttcagaaaataaaggaggttggaacaaagaaaaaataattcctagtcccacactctgatgacaaattgcttaacattttgatgtgtttccttctggtctttttaatggtcatttattaagtacctgctacttaccaggcaccattcgaagtctagacagctgtgggaaagaggagggggtcactgccttgagtaatttttagtctactcttaaaaaataatgttttgggttgggcacagtggctcacgcctgtaatcccagcactttgggaggctgaggcaggtggatcatttgaggtcaggagtttaagaccagcctggccaacatggtgaaaccccatctctactaaaaatacgaaaattaaccaggcgtagtggcaggcacctgtagtcccagctactcgggaggctgaggcaggagaattgcttgaacccgggaggtggaggctgcagtgagctgagatggccccactgcactctagccctggtgacagagcgagactctgtctcaaaaacaaaaacaaaaacaaaaaaataatgttttattatgtttttctgatgattaaagtatacataggaaactatggaaaggtaagaataaggaagtaaaattctattcatatgtaattttcccaccatcaatgcctgaaagaacatttgggtgcattttcttcaagtattttttatgcctttatatgtttatgccctaggggctttaaaggagcctgaaccactgacattggtgatgtgaatgtctcttcattttccaggattgctttggaatgacattatatatatatatatatatttatttatttatttattatactttaagttctagggtacatgtgcacaatgtgcaggtttgttacatatgtatacatgtgccatgttggtatgggatctaattaaactaaagagcttctgcacagcaaaagaaactaccattagagtgaacaggcagcctacagaatgggagaaaatttttgcaatctactcatctgacaaagggctaatatccagaatctacaaagaacgcaaacaaatttacaagaaaaacaacaaccccatcaacaagtgaatgacgttcatgaaaccaaggtcaaggaccttccagtgtaggcaggaagcatctgttcctacctctgcctatgcctcatgcatagaggatatgaaagagtaggaaaagctgctctttagagtaactcgggcctcagctcgaatgctggatctgtccccttgcttcctgctgtccctagccaagttccttcacctctctgggcctcagtttcctcttctgtaaaataagaataataacagtacctaccaaaagttgttggaaaagtgtatgtattcagtgggcgcttaataagtggaaacttatgattaagaatgtcattgtctgtatccttttgcctttgacctcaagagctataagggaagaaacatgactgaaccagaagcaaatccatcgtctcttttttagataaatccattgtctcttttttacaggcatgagccaccatgcctggctaatttttttatttatagtggagacagggtttcactatgttggccaggctggtctcaaactcccggcctcaggtgatctgcctgcctcagcctcccgaagtgtttggattacaggcatgagccaccacacccagctgtctgtctgtctgtctgcctctatatctatatctatgtctatatctatctatttatctatctatctatcgagagaatggaaaactgaacagcagaccagagctaaatttatcaatatggataaatctctcaaacaaagaggagtagaaaaagtaatttgctgccgggcgtggtggctcacgcctgtaatcccagcactttgggaggctatggtgggtggatcacctgaggtcaggaatttgagactagcctgaccaacatggagaaaccctgtctctactaaaaatacaaaattagccaggtgtggtggtgcctcaacccgggaggttgaggcaggagaatcactgaatccgggaggcagaggttgcggtgagctgagattgcgccattgcactccagcctgggcaacaagagaaaaaaaaaatagaaaaagtaatttgcggaaggatgtgtacagtgtggtactctttatttaaagtttgcagtgcaaaacgatattgtatgtttccaatgtatgcatacaggataaaggaaaatgaaaaaaaaagcatgcataggactgggtaggcactgaattcaagggaatggtcacctgtgggttggagttgggaggaagaatgagctggggcttcaatcgcatctttcttctttctttcaaaaactttaaacaactatggaaaaatcaagatttgacagagccactggatgggtgctcatatttaaatatgctttaaatatttcatgattcaaaaagagagagtgaactacagaattcaccctggaatcatgacagatcatctctgtctgggaaagatagttcttccctactgatgacttcaagttttttctctttcctcttctctccccaggctctctttaaactgtggggctccccagacaagtatcccaaagacatcctgacatacactgaattagtgttggactctcagggccagctggtggagatgaaccgacttcctggtggaaatgaggtaatagctcagcggagcctaacccctggctggagtcacccccttaaaaatatttttgggccaggtgcagtagctcacacctgtaatcccagtgctttgggaggccaaggtgggtggatcacttgaggtcagaagttcaagaccagcctgggctacatggtgagaacctgtctctacataaaattttaaaattagctgtgtgtggtggtgtgctcctatagtcccagctactcgagagactgaggcaggagtgattgcttaagcccagaaagttgaggctgcaatgagctgtgattgcaccactgcactctggcctgcgcaacagagcaagaccctgtatctaaaaaaaataataataactaaaataaaataaaaagttttcccccaaagaaacaaactcattttccttgtgcattcatccccttgccaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaagtacgtcgtgaaactggcggggcagggtgattctgctcagctactactgtattttcagtgggagtgctagcacctgcaagaggtgaaaaaaatctcacttatgtataaagcacagatgtacatgtagtgtataaacaggcatacagtgtatcagtgatactaacatttcactgtggcgggggggatggtgatgagaaaaaaaagatctaaaaaggctccttaacggggataatgaaaaaagtctataaaccctgagctgatatacactgagcgctcctgaatgcagtgtgcactgagaatgcagaggtgattgtgtcaactccctggcctcatagcgttcttagaattatggctcacacctgtcatcccagcaactcaggaggcttgggtgggaggatagcttgaagccaggaattcatgaccaagctaggtaacctaggcagcatagccagacttcgtctctactaatgaaaaaactaggtgagcatgatggtgcctgcctgtagtcagcctcagctacttgggaagttgaagtgggaggatcacttggagcccaggagttcaaggctgcagtgagccatgatcatcataccactgcactccagactgggcaactgagtgagaccccccatctcaaaaaaaaagaaaaatctttggggagttgtatagataccagcttgccataaaaggcaagatgaatgagggaagcgcacgcattctgtgatgtgaaatgacaggggacagtcatcctttccattcagagcatgcattctcgggggcgatattgcccactacccccaagaagacagaaaaataatttttggggtggcaataaaatagtttttaacatatatacatatacagagtatgtaaatagtggttaaacagtgtatcttgaaaattaaaatttcatgttggggtgctggcaataagaaataaaaatgagatagtccttagaggagagcttagctcaaagcagaacttcagtttatggctgttattaatacggtatttacatgagatgtgttaatgtgtcattgacatgttactaacatgttattaacatccatccctacgatgttcacattaagaaaaaaaaaacagtggctttcagtgcagggaactggattcgtagcctcactaaagtattttttaagggatttaaatacctgtacctgactccccaagactacaccagaatcagctccctgaactccgtccactgtaaacacatcgaggaaggaggagagtccaggtaaataacttatcaggtagctccttaattttgctcatggttaatttcagctgtcttctttcctcggggcttgtggcgatattttccagtggggtggtggtgtttgtatgatgggaaccaatgcctgttgggggcactgatgccttaaacatttgttaaactctccaaggtgagtccatccttgtcattctaaaatgagtgactcctttcacaaaaaatagcacgtcatgtagggagaatgagattggattctcgtgaatctcctaggagccgcaggctcacattttgtgaccaaactgatgcagcggtgacttggcaaactgggaaggtatgggtggggcagagagaggtctgttcttcgagagcattcaaaggctactatcttttccaggacaagttatgtttttctcagtgggattaactgactcaggatttcctagactgggttttttgcaatgttagtgacaagctggggggaaattccatagtcagatgagtttgggaaacactgggttaaatgagatctcataaacatctttattgcagaccttcttagtacctgtagcatgctgtattagtcagcgttctccagagggacaggactagtaggatatatgtatatatgaaagggactttattaaggagaattgactcacatgatcataaggtgaagtcccatgataggctgtctgcaagctgaggagcaaggaagccagtagtggctcggtctgagtctaaaagcctcaaaagtagggaagccaatagtgcagccttcagtggccaaaggcctgagggcccctggcaaaccactggcgtgagtccaagagtccaaaggccgaagaacctggagtctgatgtttgagggcaggaagcttccagcatgtgagaaagatgaaagccagaagactcagcaaggcagcttactccaccttctttcacctgctttttctagccgcgctggcagctggatgactggatggtgcgcacccacattgaggatgggtcttcctctcccagtccactgactcaaatgttaatctcctctagcaacaccctcaaagacacacccagaaacagtactttgcatcctaaagttgacacttaatattaaccatcacacatgctaaagtgcattgtgaatctctaacagaggctggcgggacagtgtttctcattatgtggccctggaatttttgattgattgattgtgaatgggtttcctctgtgtacccccatctctctgtagaccgttggaggaatatgggccgagggtgatatttcactgagacagcccctgaacaggcagatatctttggttgtataaaccaaaaagtatctgagacaggtctcaatcaattgagaagtttattttgccaaggttagggacacatccagaagcaaagaacacggaatcatagaaaccgtctgtggcgtgtacctttcttcaaagatgatttggagggcttcagtatttaaaggagaaaagcaggctggaggggaaagagggaagttctggtaatcacatgttgcaggagaaaaggcgcaggcaggggaagtcagttatgtattcttcctgcgctcagtaagtcagcactttctataagataaggtggacatagaggaactacctgtggagatatttcagcttttatctgtatctatctgcttactaaagaaacaaaaggaaaggcagcttgcacaactcagcttcagcttaaattgttccttttggcattgtgaatcgtggtcctagtttttattttcctttcacagatgggagcagtgtgatgatttatttatttatttgagacagaatcccgctctgtcacccaggctggagtgcagtggtgtaatcttggctcactgcaacctccacttcccaggttcaagcgattcttctgcctcagcttcccaagtagctgggattacaggcgtgcaccaccacgcccagctaacttttgtatttttagtagagatggggtttcgccatattggccaggctggtctcaaactcctgacctcaagtaatctgcccgcctcgtcctcccaaactgctgggattacagagcagggtgatgattgttgatgctgcacttgcccttttagaaatcttagcactcattttgagggttctagatgccaatttcattttgcctctggatgctttgtctgcttccaatctctcaccttgctgcccagtcagtcccttcttgggaaatgcatccaccttggattttttggggctagagcccagcctttaacctgtgcttgcttttgaagatacatgatcacggatatcatcgggaaggatgatggcttgggcgtggagaatctgaggggctcaggcatgattgctggggagtcctctctggcttacgaagagatcgtcaccattagcttggtgagtcttcttctattttctcttacttttcaactttccattatagaaactttaaaattgtcacaaaattagagagaatcaataataagccccatgtgcccgtcacatacctcctacagttaccacatgccagcccactgatatttcctcaatctcacccccatcccctgcacctgttttagagtattttaaagccagcccccatcatgtcttttcatccataaatacgtaagggtagatctttaacagataatgactctcaccctcttcccccggtttttaaaaacataactgaaatactaatattacacccaacagaatcagcaatatcattgaaacccagtgtggtttaacagttatctcaaaatacccttttctagtggtttgtttgaatcagggtccaatctcatcttattttcaaggtactgaatgtttagaagaacttttctctgactttaactggcatataaggagtagtccccatcccatccccatggcctttccaaaaatgttttctgtttctagtagtagtactactgtagtagtagtagtagtactagtagtaattctagtactagcagtggtggtagtagtggtggtggtagtagtagtagtggtagtagtgtttgtggtggtgaatctgtatgggtctaaggcagagtgagagaccgaggcaagtctctcagcaggagtgaaagtttattaaaaagttttaaagcaagaatgaaatgaagtacacttggaagagggccaaacaaggcaacctgagagatccaagtgcctcatccaacccttttgaggttttatgcattggcatgattccagggtttgtgtttcttctcccctgattcttcccttggggtgggctgtctgcatgcacgtggtctgccagcacttaggaggggccgcatgaacagtgtgtttactgaagttgtgtgcatgctcacttgaggctttcctcctttaccagtcgagtgttcctagaagaagggcacggtaccagataaactctgccatcttacctcttagcatgcatgcttgagcccacccacccagctcctgagatcttatggggaagctgcttatcactagcttcaggtgttttctatctatcaggagattgcctttccctggagccagctgtgaccaatattaattttagagagacactttagcaactgcctaactatcacctgatggttgccttcctctcctgccctgctcatgtctgcttaactacctactctaacagcagcagcagcaggaataatagtactctttaatgataaactgccttggaaggccttatttgtacatgcaatgttgaatcttcagtttccaagtggaaaatgttggtcataagcatcttccttgggcttgttttctagattatatgtatagtctttttattttgaagtcatctaggacccaccgtaagttataagatactacagagaatttccaagtacccttcacccagcttcccctatggtacttacataaccgtagtacattatcgaaaccaggaaactgacattggcacaatattgttaactcagtacagaccttattttgaatttcaccagtttttacatgcactcctaggtgtccttttggttgttaagaggctgcaatggcccatgaatgcccaggctcagaagagctgcacacaagcctcttaaaatctgaaacattcactgtctgctgcttgtctttacagcaatctttgttaaccatgttatttccagataggaatccaagctcaataaagtggcctgaagaataggcttttgcctctactgtggtttggctccaaatcgggttgccattggtcaaaacataacttccatttggtcccagcaggttcctggactcttccctgctgtggggggtgggtccctcgccactctccagaattcagagggggtcctctctccacaggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctctggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttaatttatagtgaatatgcagttttgtattctacttttttcactgtattaaaacattttccttgttgaaaagtctctatacttaatgtctgctcaaatctcagccaaagtctcaaagcctggttcttgaaccaacagcatcagcatcagatgggaacttgtcagaaatgcacatcctcaagccctgctgcagacctgctgaatcagaaacactagctagggttttgcttttgagatggtcaaggtagaagtcagctgcatcaccagttctcaaattggcctgcatattggaattatctagaaactaaaaaacaaacaaaacacaaaaactaattcctcgaagattctgatataattggtctggatgtagcctgagcatcaggatttgtgaaatctcctgggtgattctaatgtgtagccaggattgagaagcactgagatgatttccaaacaggtggtagagccctgcaccgtgcaggacattgctaaccatgttgtgtcaaagcaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggtgcagtactccccctgcagcttagaacctggaagactcttattaagctcattggctaattctgtccctgtcacctcctgggtggtgtgggaggctgaggagcaggaagcactgcacatgtggctggggttgatttttcttactccttcttccttctctgatgcccagccctgtactaggtgtcctttgctcttttggtggcactaatgccattgtaaggatgctatctgttaatcctttagaaagaggtagtattgcctcttgacaagaggcagcattggacaatactgagtctttaagctttacagtcaggctggatttgattcctgccttcctcctcggtagctgtaagacactgggagagtccctaagtttttctgagcctgtttcctcatctgtgaaatgagaataataatagcacctaactcatggtgttatcatgatgattaagtgaagtgatatttaaagcacaacgtttggtaggtcctcaccaaagtaagaaggggacaatcgtgggcacagttcttggttaactgtaacattccttacaaatgagtgaggttgtcattcttcattataaccatttctgagaggttgggtttacagagttcaggtcattccagatcttctgccaagaaccccaagtcacaaatgtcagtttgtattcccaagtgccccttttccccatctgcatgccatctgttaccattctctgcaaccaatctctttttctttcttttaagatgtttttcctcctatctgaccatatatagcagtagcaaccctttcctgcgtttctgtaacttcccagcatcagtgacaccatctgaaccgggaagcacactcaggagttcataaactagatttcagaagaatccatgggatggccagtccttatctggcattttccaatcagagcagtggcttcaggagccctagggaggggatattgctgcataaccaggcataatcatagtcagaggagcaaagtgctgatcagaggtattattgacaagcaccacagactaagtcagagacttggctttcttttttaggataatcacagccctgtccctatcatcacacccactgaccccattgacagagaaattgaattcctcccatccagagctccctacgacccccggtggatgcttgcaggaaggcctcacccaagtaagttctaaagtattttgcctaggacctggtctcgggtttctttctagggcttgagacaaaggagcactttgtctcaagcgcttgagacaaaggcttgatattcgttctcatatcccagagaggtatacctgaaatcaaatgcagggaaagtagagaaatggagattttactctaggcttttcctgagccattgaccaagaaggggtggaaacagcctccagtttctggagctaatagatggaggtggggtgcaatggtggtcctggtctccctcccctgatgctccatgctccgtggtctctaactgccccactgtctcatcagtagaaaattcagtgctgaaacatcagagtttcaaagagaagactgcatctttctctttctttctctcttacaaaggaactctgtgagtttacacaggataggcaatctggtctcctcttctttttttttttttgagacagtgttgctctgtcgcccaggctggagtgcagtggcgcgatcttggcttactgcaatctctacctcctgggttcaagtgattctcctgactcagtctaccgagtagctgggattacaggtgcctgccaccacacccagctaatttttgtatttttagtagaggcggagtttcaccatgttggccaggctggtcttgaacacatgacctcaagtgatctgcctgcctcagcctcccaaagtgctggaattacagacatgagccaccatgcctggccaattttacctcttctatacctacacacacacacacacacacacgcacgtggacacgtgaacacacatgcacatgcacacacatttttgcacacacacattctctctctgaaagggatgagtttctctcttggaggtatattatttcagtctgagcaaccagaacacaacaggaaagttgagctgctcccgtcactatatcccaaatctagaatttcacatgctgctacctttagacttggctgctccttggctgtgcaatgcaggagaggtgaccctcgggagtgtgctagactccagccagtgcaaggagtcctgtggcttccttctcttgcttttcatttctcttgggctttctggcctgtaaacactgagggggctgcttatctcaattaaaaaatgttcggcttctcactgtcaggccagtcctcggcagatgctgaagctgtgctgttgcatgcctgggtgccgggcctcccatgcctgagatgcctcttactctggctgccccctcctggtcagagccacagccatttacgctgttgcatggatttaagtcatcatttcttccccaccaatggctgtcattgacatcatcatattctctctctgtctctctgggaaattgaaacttttttcccaattaagtggttatgaagctgcagccagcagctagcaggtgagggatgagtttttcgggaaaggtggtcccttcctaaaatcccaccttctggaggtgtctgtccactctctgcatcttaggaagagaaggcagagaccatgattagaatctatgtgtttggagttggctggctgttgatggtagtcacatattccatacagactgaattcttgacttggtatatttattgcagccctgtttgtcttttgaggcattttgggaaggagggaaggggttgggctgtgtggttttaggtagaaaggggtatctgggctatgaggttaaagccaggctgtccttagggagcttttgcacagccaggagtgtcctgggggcccccagccacctggccctccagcctgggcttctgcccttctgtccacagctctgaagggaacgtggcagagcggattctttgaccacggcagtttcaaggaaatcatggcaccctgggcgcagaccgtggtgacaggacgagcaaggtaatcatgaagacgggagcaggctgcccatgtctgactcaccaggcattggggccccgaggtgtgaggccagggacctccaggggcaattttcttcttggcctcaggattttctaaaagaaaaaaccaatttggggaatgatttctgcagtgtctgtgtgtgcccttagaaggtatctcagccagcctcctcctgaggcctgggaccctgtagtcagtccccaggccacaagggctaacaacccctttgggcatcagaaggtggccttgggtgctctccccagaaaacttcacagacactggcactctgaattccatcttaggagagccatggacaggagccctgttgtatgccactgttggtgggaggctgcaatgcttgcatgctttccaagctgggcagctcacccttcagccttgtagctttcatctctttggacagctccacctgcctgaaagttcctccttataatgagccccgagctccctcctcatcatttaccactcattcctggtacgatgtcgcagctataagtccaggctctgcattagacctgaggccaagccccatctccatcactcaccctctctggtccttcacatctgtaaaatagggataataattctaccccaaaggattattgtgatgattagatgcaataacatgtgtgaaatatttaaaatcgacatactccataagtgggaatggctgctatcatttacatcttcggcaataaatactaaagtgcagccagggccgggcgtggcagctcacacctgtaatcccagcacgttgggaggccaaggcgggtggatcacctgcagtcaggagttcgagaccagcctggccaacatggcgaaaccccgtctctactgaaaatacaaaaattagctgggcgtggtggcaggcacctgtaatcccagctactcggggggctgaagcagcagaattgcttgaacccagaaggtggatgttgcagtgagccgagattgcgccattgcactccagcctgggtgacagagcgagactccatcttcaaaataaataaaataaaataaattatatttttaaaagcaaaaaataaaaaaaaaaaaatccactccttcttccatgtgaaaacactttgatttgaagactgctctcccccacccctgcatcatagggtaaacgagaaccatgtagtgatgcacagttcagtagcaagtaactgatgtcatggcatcccctgagctgagtctctgtccagttcaatatccctcagccctttccaagtgcaacttgatgtctagaccagtgtagtagctgctggctacatgtgatgctttagtttcattattattattattattttgagacaaggtcttgctctgtcacccaggctggagtgcagaggcatgatcgctgttcactgcagccttgacctcctgggctcaagcaatcctcccacctcagcctcccaagtagctgggactagaggtgtgcgccaccacacctagccagtttttttattttttgcagatacagggtctcactatgctgtccaggctggtctcaaactcctggactcaagcaatcctcctgcttcagactctcaaagtgctgggattacaggcataagccaccatgcccggctccttcagtttaaattgaactaagtcaaagtgacagaggatgacctgttccattcctcacacttgccacgttccacgtgcagcccacagctcctgtattggacagtgcagatggagaacgtggccctcgtcacagaaagttctagtggttcatgctgctccaggccctataccatcccagccctcctctgatggttcttgcctcaaaaagggcaccaataggtctgctacctttcgaggctcttaccatttgggggctttttctttgccttccaataaaataatccgccagattaaaaagagcattctcctccacgtgccctcacccccacacccagaggtccccaaatgcacctggggtgctgcccagggcctggctcactggtgctcattttccaggcttggggggattcccgtgggagtgattgctgtggagacacggactgtggaggtggcagtccctgcagaccctgccaacctggattctgaggccaaggtgagggggccgggagctgtggctgctggtttagccagcggtactgtcgagagtgggtcctgggcgtgggggtcccatccctgccctgccaacttaggtggagaagcaggggacccagtgcagtccctggccctggggggctcagtgcctgtttctctgacactttctctatgggttgcataaatggctgcaccatcttgcttcttcctcagcagatgataaaggtccctagaaacccctcccacctcctgccctgcctctgttgctgtttctgcgctaggccagggcacagactgagaagagctcaggagtcaagagggctgggttccagggccggctttaccccaactcagtgtgaccttgacgagcttggcacccctcggagcctgtaaaggagggcaacgggaaccttgctgggctgcaatgggagggtcagcctggtcctgagcggaggagatggggcttccatccttctgagccctggctctggtgctggggccagcacagatcagatcgcctgccatccagagcgaggttctggcagccgtccctctgtcctgggttgtggttgtgcagagacatctgatccccgcagctctgtgttccagataattcagcaggcaggacaggtgtggttcccagactcagcctacaaaaccgcccaggccgtcaaggacttcaaccgggagaagttgcccctgatgatctttgccaactggagggggttctccggtggcatgaaaggtaagcccctccctgcctatgttaccccaaagccttggggtcagcacccaggacagcaccctctgggtggtgatgctaatgtcctagtctgtgcccatcatcatcttagctgtgtctcccaacaaccctgaggagaaaatattgttcaggtgccccactaccccgttttaaagatgaggaactgctgggcacagtggcagacacctgtaatcccggtgctttgggaggccaaggcagaaagatcatttgaggccaggagtttgagaccagcctggggcagtatagcaagaccctgtctctacaaaaaaacaaaataaatgtttaaaaaattagctgggcatggtggcacatgcctattgtcccagctatttgggaggctgaggtgggaggattgcttgagcccaggaggttgaggctgtactccagcctgggcaacggagtgagacccccatctcaaaaaaaaaaacaaaaaaacaaaaaaaaaacaatgaggaactgagggttggaggcaaagtgtcactttctagaggtcacaccatgaggtgcaggtcagggaggggcagccccaggagctgccgggtgacctgggcaggcacctccccatttggcaaggtgaggaggatgtttgtccacccttccctctgcagaaagctgctctgagcctcatgtgaccttacaattgtgtgagggctttttaagccaccaagcatgttttgggagagagtggctgttggatcactggggtgttgaggacagagctggatgggaggcagacagacctgctgtgagtccttgttaactgggtgacatcactgagcctcagtttccctcctttgtaaaagggggttaagaacaggaccaacctcagagggccgaggtaagagtctgatgagctaattgctgacatgcagtgtgattgtcagtgctgttattattgcattcttgttttcatgtagggtgcctggggacctggagagatgtgtcttggtggaagataagggccatgttgcccatgcacattggggaaggatcagtgtgactgttagtgagggttttctttgctggaaatggtggggcagggcagggacagtcatgggtgagggcatttcaattccagttggaaagaatcctagagattggtttttccctgtgccttcacagatgaggccactgaggcccacactgggtgaatgacctgttcgaggtcacacagccacttagagagtgatcagtactctcaaatcccagcccagtgctctccaagcctctcagctgggctcactctcccaggacccccaggacaactagggcagtgggtttcatgtgtggatgagtgagggccctgaactgggaggctgctttgcttttcagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggtgggtgtgttgcccttagcctggcttagccttttcttgttctcccagccttgagagcccatgaccttgggagatcatggagggatgcagtggctggaacctgtaagtggtggagaaatgttgtctcttctttcatggtttccacttccccttcccaaggaagtttgcaatcaaaaaataaaaaggaaagaccaaaagcacttgaacttcctggcagccaggatgaaaagggaaatatgatgagccatttatctctcattagactctgagctatgagttcctataggaaatgttttattcagttttatatcccagggtctagcacagtgccttactctcctggtaggtggtcagaaaatactggctaaacaaatgactgaatgaatacttgcatgagaggataccggttcttcgcgggagaggtaacctccttggcactttccttaggaggaatttattccagagattcttacagaaaggatgatgacaataatgttcacagcacagtgactgatgactttgaagtgaaaactacatgctacacaggatgtcaaggcctcaagagtcattctactccaaatataggcacggcattcctgtgttcactccctcattcatttgctaattcaatgaatatccattgattacctcactgtatgccagccattctggtagacattatgatatggtggcaaatgggccaagcttgtcctgcattcagggcacttagacccttgttagggactgctgaggtcagtcctccaggaagactcaggatactgagcagcacttgaatggagtcattgctaacttttcatgctggccaccaggaagctcagagctactgatagcattcttcagggcttctaagctgtcaaaagcaaaagggggcagggggagaataaggggtaaataaaaatgttggaaatgaggccaggcgtggtggctcacgcctgtaatcccagcattttgggaggctaaggggggcagatcacttgaggccaggagttcaagaccagcctggccaacacagtgaaaccccgtctctactaaaaatacaaaaattagctgggcatggtggtacacgcctgtaatccaagctgctcggggggctgaggcaggagaatcacttgaacccgggaggcagagattgtagtgaaccgagatagtgccactgcactccagcctgggtgacagagtgagaccctgtctaaaaaaaaaacaaaaaaaaaaaaaaagaaagaaaagaaaatgtatgttggaaatgggaggacagctcacacaagactacactgggctctcaaggtgcttttgtgagatttaaagcgatcagaaacagtgcccctcctctaggagggcagaaattagcaaagttagagaggactgtggctggagagcaggagggttatgctgccatggaaaaagtcgtacactcttagacctgaaaggggccctccagagttcagaaagcattattttaaacagttggctcagtctttccatctgtgggtaaagatacagaggcccagagagggaaagtgacttgtctaagggcacacagcatgtgtgggggtaaaagagctgaggactgacacccagatcttctggctctcttccctccagctccccccacatccattagcccttgcttgctgggcaatgcctcatatacccccatccctgcctcttctcttttaaggggtggtgttctggaaccagaggggacagtggagattaagttccgaaagaaagatctgataaagtccatgagaaggatcgatccagcttacaagaagctcatggaacagctaggtaagggggtcccaaaggcttcacctctcagaggtcaagagaggcccagctggcccactgctgggggtttctaggatgttaaaaataaaatgaaaaaataccaaaatacagctataataactgtgagatttttaaagatattcacatttgtctgtttgttttgttttgtttttttgaggtctggctctattgcctaggctggagtgcagggtgcaatctcagctcactgcaacctctgcctcccaggcataagccatcctcccatctcagcctgagtagctgggactacaagtacgcaacaccatgcctagctaatttttgtatttttgtagatgtggggtttcgccatgttgcccaggctgttctcaaactcctgggctcaagcaatccacctacctcagcctcccaaaatgctggggttacaggcatgagctaccatgattggaggacattcacatttctaaatcaacctttttaacattatatatatatatatatatatatatatatatattgccatcgtgaatttatttctcagcatacacaaaagatagcaattgaagtatttggggctgatggggattatcagaattttggtggcaaaatgttcctttagaattcccaatcagagataagatattttactaattttgtttgaatgacagctttgttttacttgtcatctttagatgtaattatctttatttatttatttgtttatttttgagacagagtcttgctctgttgcccaggctggggtgcagtggcgcaatctcagctcactgcaacctctgcctcccaggttcaagcgattctcatgcctcagcctctcaagtagcaggaattacaggtgtgtgccaccacacctggctaatttttgtgtttttagtagagacagggtttcaccatgttggccaggctggtcttgaactcctggcctcaagtgatttgcctgcgtcagcctcccaaagtgctgggattacaggcgtgagccactaagtctggccacaagatgatatttaaatatccattttaagtgtcagtgtctttataactgtgctattcacaagattttttacagtgtgtgcgtgtaatttctttggctggtatcagggtaatgctgatctcatagaatgagttgaagtgttcgctcctattttctgagtttttgcagaattggcattatttctttatgtttttgatagaggtttttacctataaattcaacttctttgttatatataggactatttgtgttatctgtttcctcctaggtgagctttggtggtttgtgtgtttcaaggaatttgtctatttcatcttaagttgtcaatttggcatagagttgcttataatattcccttatcatattttacaatgtgtactaaaaatcattgatatagtatcctacaagcacgatgggtctgatggaaggggaaaatgtagagttgcatgttgaatgctgtcttgcaattgtgagtgcatttctgagactgtactagctatttgatctgagacaaagggggccatcaagatgggcctggggtgggggccaggccagtggactctgggggacctagggggctgagggcagcctgtgtagcagcaggggtaatatcagagttaaagctcagacctctcacaaggcaaggcctgtcctgcaaatcctgatttgtgccttcttcaaaaaaaaaaaaaaatctccaccccatcacatatgaccagcttccatggcttgactggcctttctgctcacctgcaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgtgagagccacagctgccgtgtagggtgcaaagagcccaccctgttttccaaaacatggaggacatttgggctcgggggcggggagggcggtggtggttgggatgggtcaaatgctgcaggaggtgggagtcacctgggaactttaaaataatcccgatccccaggtggcactgcagaccagtgaaatccaaacacctggatggaagccaggcggtcgtattttttaaagatccccaagagattctaataagcagcaaagttcagggaccactagtctgatggctcggtcagtttggacctggaccaggggtagaaaccgttgttcctgtccagcattcacccacccctcaccattgcaaggactcccacagtcacctcctacccatgtccagtgctcattggttctcttgctgcattgttctccctcccagctgactcatgcctcacacgagcctgtgtttgtgtcggttgaggtagaagtgggtgccaggtttttatgggggacattttttcaactatggccagtctggagtcctggtgacgtcctgcctctgagcaggtgccttctcctccctgagcctcagcttacttgcctgggatgatctgggaatgatctcagagcctgggcccagccccgggcagccactgtcatgggtgtggtcagagccagtgtcccgtctcctccttccctttccggggattcaagcctggctcgtccacaggacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggtgggcctggggtgagaacgaggccggtgagcacagggggtgctgggggctgagacagctggcccacagctgggtccctctctgaggcatcctctgccccctccccaggcctacttgtgggacaacaaccaggtggttgtgcagtggctggaacagcactggcaggcaggggatggcccgcgctccaccatccgtgagaacatcacgtacctgaagcacgactctgtcctcaagaccatccgagggtgagtggccaccgcacctgcttcccagcctcctggcaaggacccgagcctggattgacccctagctacccgactcctatgcagccacttgaacccgccaccctgtgcagtctggggttgtccccgccccctccccgctccccagcaaagagaccacactccctaatgtcgggtctcccagcacagtggctggggtgggacagagagcctagaggtactctgaaggccgtgtgagatgcttccaactcatgaaccttgctggaatatggacttgtccaaagtcacagctggagcagggttggtcacagaacccacatttggaaccgctagccttcaggctgctgtcttccacgccagtgttgacctttccagagggtcccctcccccaattgccatggggtcaccccgtgaaggagggagtcgagcacaggggaccccattttggggatgaagctgagactcaaggcagtgtcttgtctcaggtcatgtcacaaagcagtgaccagtagggacggtggtgcctcaaggcattctgaacttcaggtcacagcccctcctgctgcacaggaccatcacccccatggggaccacagcagggactcgggagctctgggttctggggtgtggccccacacaaggactctgccacccttggggccactgaaaaagtggctggagtgatcccagccctcctctcacctcccccacagcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgt

SEQ ID NO: 14-16 - skipped (3 entries)

SEQ ID NO: 17 - DNA, 7461 bp, M. musculus
atggtcttgcttctctttctgacttgcctggttttctcctgcctgaccttttcctggctaaaaatctgggggaagatgacagactcgaagccgctcaccaacagtaaggtggaagccaatctcctttcaagcgaggagtccctttcagcctcagagctgtcaggggaacagctgcaggaacatggcgaccacagctgtctgtcctacagaggtcccagagacgccagtcagcagaggaactccctgccaagctcatgccagaggcctccgaggaacccactgtcttccaatgacacctggccctccccagaactccaaaccaactggacagccgccccgggcccagaggttccagatgctaatgggttgcccttcccagccaggcccccgagccagaggacagtatccccctccagagaggacaggaagcaggcacacatcaagagacagctgatgaccagctttatcctgggctccctggatgacaactcctctgatgaggaccctagtgccggctccttccagaactcctcccggaagagcagcagggctagcctgggcactctgtcccaggaggctgcattgaacacaagtgatcctgaatctcacgcgcctactatgaggcccagcatgtctggactccatctggtgaagagaggccgagaacacaagaaactggacctgcacagagatttcaccgtcgcgtccccagccgagtttgtcactcggtttggaggcaacagggtcatagagaaggtgctcatcgccaacaatggcatcgctgcggtcaagtgtatgcgctccatccgccgctgggcctacgagatgttccgtaatgaacgtgccatccggttcgtggtcatggtgacgcccgaggatctgaaggccaacgcagagtacatcaagatggccgatcagtacgtccctgtcccaggaggacccaataacaacaactatgccaatgttgagctgatcatagacattgccaagagaatccctgtacaggccgtgtgggctggctggggccacgcttcggaaaaccccaaacttccagagctgctgtgtaaacacgagattgctttcctaggtccccccagtgaggccatgtgggccctgggagacaagatcgcctccaccatcgtagcgcagacactgcaaatcccaaccttaccctggagtggaagcggtctcacagtggagtggacggaggacagccggcaccagggcaaatgcatcagtgtccccgaagacgtttacgagcagggctgtgtgaaggatgtggacgaaggcttgcaggcagcagaaaaaataggatttcctttgatgatcaaagcctccgaaggcggaggcgggaaaggtatccgcaaggctgagagtgcagaggacttcccgatgcttttccgacaagtgcagagtgagattccgggctcgccgatctttctaatgaagctggcccagaacgcacggcacctggaggtccaggtcttggcagatcagtatggaaacgcggtgtcactgttcggacgggactgttccattcagaggcggcaccagaagatcattgaggaggctccggccaccatcgccgcgcctgccgtgtctgagttcatggaacagtgtgctgtcctcctggccaagatggtgggttatgtgagcgcggggactgtggagtacttatacagccgggatggcagcttccacttcctggagctgaacccacgcctgcaggtggagcatccgtgcactgaaatgatcgcagatgtcaacctgcctgctgcgcagttgcagatcgccatgggcgtgcccctgcaccgactgaaggacatacggcttctgtacggagagtccccctggggagtgacccccattccttttgaaacccccttgagccctcccattgcccgaggccacgtcattgcagccaggatcaccagcgaaaacccagatgagggctttaagccaagctcggggacagtgcaggagctgaacttccgcagcaacaagaacgtgtggggttacttcagcgtggccgctgctgggggcttgcacgagttcgccgattcccagtttgggcactgcttctcctggggcgagaaccgtgaagaggccatttcgaacatggtagtggctttgaaggaactgtccatccggggtgacttccggaccactgtggagtatctcgttaaccttctggagaccgagagcttccagaacaacgatatcgacacggggtggctggaccacctcatcgctcagcgggtgcaggcagagaagccggacatcatgcttggggtggtgtgtggggccttgaatgtggcagacgcgatgttcagaacctgcatgacggaattcttgcactccctggaaaggggtcaggtcctccctgctgattctctgctgaacattgtggacgttgaattgatttacggcggcatcaagtatgctctcaaggtagcccgacagtccctgactatgtttgtcctcatcatgaacggctgccacatcgagatcgatgcccaccggctgaacgatggggggctgctcctgtcctacaatggcagcagttacactacgtacatgaaggaagaggttgacagttaccggatcactatcggcaataagacttgcgtgtttgaaaaggaaaacgaccccactgtcctgagatccccctcggctgggaagctgatgcagtatacggtggaggacggagaccacgtggaagctgggagcagctacgcggagatggaggtgatgaagatgatcatgaccctgaacgtgcaggagagcggccgggtgaagtacatcaagcggccaggggttatactggaggctggctgcgtggtggcgaggctagaactcgatgacccttcaaaagtgcacgcggcccagccgtttactggggagctccctgcccagcagactctgcccatcctcggggagaagctacaccaagtgttccacggcgtcttggagaatctgaccaatgtcatgagtggctactgcctgcccgagcccttcttcagcatgaagctgaaggactgggtccagaagctcatgatgacgctccggcatccctccctacctctgctggagctacaggagatcatgaccagtgtggccggccgcatccccgccccggtggagaaggcagtccgcagggtgatggcccagtacgccagtaacatcacctccgtgctatgccagttccccagccagcagatagccaccatcctggactgccatgccgccaccctgcagcgtaaggcggaccgagaggtcttcttcatgaacacacagagcatcgtgcagctggtccagagataccgcagcgggacccgtggctacatgaaggctgtggtgctggacctcctgaggaaatatctaaacgtggagcaccattttcagcaagcccactatgacaagtgtgtgatcaacctgagggagcagttcaagccggacatgacccaggtgctggactgcatcttctcacactcccaggtggccaagaagaaccagctggtgaccatgctgatagatgagctgtgcggcccagaccccaccctgtcagacgagctgacctccatcctctgtgagctcacgcagctgagcagaagcgagcactgcaaggttgccctcagagccagacaggtcctgatcgcctcccacctcccctcctacgagctgcggcacaaccaggtggagtccatcttcctgtccgccatcgacatgtacggccaccagttctgcccagaaaatctcaagaaactaatactttcagaaacgaccatattcgacgtcctgcccactttcttctatcacgagaacaaggttgtctgtatggcgtccctggaggtttacgtgcggagaggctacatcgcctacgagctaaacagcctgcagcaccgggagctcccagatggcacctgtgtggtggagttccagtccatgctgccctcttcccaccccaaccggatggccgtgcccatcagtgtctccaaccccgacctgctgaggcacagcacagaactcttcatggacagtggcttctccccactgtgccagcggatgggggccatggtggccttcaggagatttgaagaattcaccaggaactttgatgaagtcatctcctgctttgccaacgtgcagacagacactcttctcttcagtaaggcgtgcacttccctgtactcagaggaagacaacaagagcctccgagaggaacccatccacatcctgaatgtggccatccagtgtgccgaccacatggaggacgaggcgctggtgccagtcttccgtgcctttgtacagtccaagaagcacatccttgtggattacggactccgaagaatcacattccttgttgcccaagagagagaattccccaagttcttcacgttcagagcgagggatgagtttgcagaagaccggatttatcgccacttggagcctgccctggccttccagctggagctgagccggatgcgcaactttgacctgaccgctgtgccctgtgccaaccacaagatgcatctttacctgggagccgctaaggtgaaggaagggttggaggtgaccgaccacaggttctttatccgagccattatccggcactcagacctgatcaccaaggaagcctccttcgagtacctgcagaacgaaggtgagcggctgctgctggaagccatggacgagctggaggtggcgttcaacaacaccagtgtgcgcactgactgcaaccacatcttcctcaactttgtgcccacagtcatcatggacccgctcaagatcgaggagtcggtgcgtgacatggtcatgcgctatggcagccgtctgtggaagctccgagtgctgcaggccgaggttaagatcaacatccgtcagacaacctcagatagtgccatccccatccgcctcttcatcaccaacgagtctggctactacctggacatcagcctctatagagaagtgacggactccagatccggaaatatcatgtttcattcctttggcaacaagcaaggtagcctgcatgggatgctgatcaatacaccctatgtcaccaaggacctgctccaggctaagcgattccaggcacagtccctcgggaccacctatgtgtacgacttcccagagatgttcaggcaggctctctttaaactgtggggctccccagagaagtaccccaaagatatcctgacatacacagagctggtgttggactctcaaggtcagctggtggagatgaaccggcttcctggttgtaacgaggtgggcatggtggccttcaaaatgaggttcaagaccccggagtatccagaaggccgggacgccgttgtcatcggcaatgacatcaccttccaaatcggctctttcggcataggggaggacttcctgtacctgcgagcgtctgagatggcccggacagagggcatcccccaaatctacctggcagctaacagcggggcccgtatgggcctggctgaggagatcaaacagatattccaagtggcttgggtggacccagaggatccccacaaaggatttagatacctgtacctgacgccccaagactacacccagatcagttcccagaactcagtgcactgcaagcacatcgaagatgaaggcgaatccagatacgtcatcgtggatgtcatcgggaaggatgccaacctgggtgtggagaacctgaggggctcgggcatgattgcaggagaagcttccctggcttatgagaaaacggtcaccatcagcatggtgacctgccgcgcccttggaatcggggcttacctggtgaggcttggccagcgggtgatccaggtggaaaactcccacatcatcctcaccggagccggtgctctcaacaaggtcctgggaagagaggtctacacgtccaacaaccagctaggtggcgtgcagatcatgcataccaacggggtctcccacgtcaccgtgccagatgacttcgagggggtctgcaccattctggaatggctgtcatttataccgaaggacaatcgcagcccggtccccatcaccactccttctgaccccatcgacagggaaattgaattcaccccaaccaaagctccctacgaccccaggtggatgcttgcaggcaggcctcacccaactctgaaggggacctggcagagtggattcttcgaccatggcagtttcaaggaaatcatggcaccctgggcccagactgtggtgacgggacgagcaaggctggggggcatccctgtgggagtgattgctgtggagactcggactgtggaggtggctgtccccgctgaccctgccaacttggattctgaggccaagatcatccagcaggcgggccaggtgtggttcccggactcggcctacaagacggcgcaggtcatcagggacttcaacaaggagcgcctgcctctcatgatcttcgccaactggaggggcttctccggaggcatgaaggacatgtatgagcagatgctgaagtttggcgcctacatcgtggatggtctccgcctgtacgagcagcccattctcatctacatccctccctgtgcggagctccgtgggggctcctgggttgtcctggactccaccatcaaccccctgtgcatagagatgtatgcagacaaagagagcagggggggtgttctggagccggagggcacggtggagattaagttccggaagaaagatctggtgaaaaccataaggaggatagacccagtgtgtaagaagctcgtgggacagctggggaaagcccagcttcccgacaaggaccggaaggagctggagggccagctgaaggcccgggaggaactgctgcttcccatctaccaccaggtggcagtgcagttcgcagacctgcacgacaccccgggccacatgctggagaaaggaatcatttctgatgtgctggaatggaagactgcccgcaccttcttctactggaggctgcgccggctgctgctggaggcccaggtgaagcaggagatactccgagccagccccgagctgagccacgagcacacacagtccatgctgcgacgctggttcgtggagactgagggcgctgtcaaggcctacctgtgggacagcaaccaggtggtggtccagtggctggaacagcactggtcagccaaggacggcttgcgctccaccattcgtgaaaacatcaattatctgaagcgggactctgtcctcaagaccatccaaagtctggtccaagaacatccagaggtcatcatggactgcgtggcctacctgagccagcacctcacgccagccgagcggatacaggtggctcagctgctgtctaccacggagagcccagcttcctcctgatgagcaactctggccatccccaggaccctggacggtgggatggccatgcggcaggccttcgagggacacgggcttattttgggaaaactcacggagccactccaaatgtagctg

SEQ ID NO: 18 - DNA, 87616 bp, M. musculus
  misc_feature (1)..(87616): n = A,T,C or G
aaggccaaagttgaaaagcttgtgtttaatgagaatcttcggtgcctcatcctgtggcagagacagatgggcaagagagcacgagacccaccctgtgacagcagaccttttcccaccgccgtggttttcctgcttgctccctgtagtactgtgtcattgccgatcacacatgaactccgggagcacacattcaaaccacagtgtatacacatatctaggttagcaacgtgccctgggccacaggcacgggaagcgctgagatcagaggagaaccccatctctgctcattgtacttcgtccagtacaagggaccccaatagccttgccccacgcgccgtgttaggagagaagtctgttgaccgtaactataaactctctcttcccttgacaggttgcctgaatggtcttgcttctctttctgacttgcctggttttctcctgcctgaccttttcctggctaaaaatctgggggaagatgacagactcgaagccgctcaccaacagtaaggtggaagccaatctcctttcaagcgaggagtccctttcagcctcagagctgtcaggggaacagctgcaggaacatggcgaccacagctgtctgtcctacagaggtcccagagacgccagtcagcagaggaactccctgccaagctcatgccagaggcctccgaggaacccactgtcttccaatgacacctggccctccccagaactccaaaccaactggacagccgccccgggcccagaggttccagatgctaatgggttgtccttcccagccaggcccccgagccagaggacagtatccccctccagagaggacaggaagcaggcacacatcaagagacagctgatgaccagctttatcctgggctccctggatgacaactcctctgatgaggaccctagtgccggctccttccagaactcctcccggaagagcagcagggctagcctgggcactctgtcccaggaggctgcattgaacacaagtgatcctgaatctcacgcgcctactatgaggtaacggaccttctcttcatactgggaatatgatttaggagtaaggtttgtatctctgattttgcagcgggattggcttccttcctcggctcctccctctgatcttctaacgcatgtgtgttagaagccatgttgaaggggtagccatgtagaagagcagaaggcaaagcctgtcttctttgcttcttgttccctcctttcagaattactgattgtgcacctgctgtgtgcaccttctgtatgcacctgctgtgtacacctgctgtgtgcacctgctgtttgcacctgttgtttatacttactgtgtgtacctgctgtatgcacctgctgtgtacacctgctgagtgttcagggttccatgccaggaaagtggctttctagagctctcagccaagctgggcacgatgatcttgtgggtgacaagttaccagttaaaaaactccaggtgatcactggagggagatctccctgcctcctaatgagacagcacttccttctttccctcatccaacagtaaactaatccccactggtgcctagactgcagaagctcaacttctgtcacctactatcagctgtatcgtcaaaaccaaaacctgcagtcactgcaggtgcggctctgtgtgtgcgtgcgcatgtgcatgggagcgtgcccatgcaacagtgcaggtgtggaggtcagaggacaactctatggtcagttctgagagtggagctcaggacattgcgctttgctgagccgggcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttccttccttccttccttccttccttccttcatcaattccttccttcctccctcccccttccttctctctctctctctctctttctctctctttctctctctctctctttctttctttctttctttctttctttctttctttctttcttccttccttccttccttccttccttccttccttcctttctttctttctttctttctttctttctttctttctttctttctttctttctttctttttcttccttcctgtgtaacagaaggtgcccttgattctctgatctttttacctctgcatcctgaatgctgggatttcaaacataggccatcacatctggccatttaaaaattctataaagttatataaagtgtaaacaaccccaagtagctagtagttatcatatcagtgtgaatctaaaacctagtggtcgggctggagagatggctcagtggttaagagcaccgactgctcttctgaaggtcctgagttcaaatcccagcaaccacatggtggctcacaaccatccataatgagatctgacgccctcttctggtgtatctgaagacagctacagtgtacttagatataataataataataaataaatctttaaaaaaaacaacaacaaaaacctagaggtcaaggaggctctaactgtgtgaattgatttaccaagaaggcagacttgacaaagttgtaacattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcctgttaaaaatgcagggagccgggcgtggtggtgcacgcctttaatcccagcactcggtaggcagaggcaggcagatttctgagttcgaggccagcctggtctacagagtgagttccaggacagccagggctacacatagaaaccctgtctcaaaacaaaaacaaaaacaaaaacaaaaacaaacaaacaaacaaacaaaatgaagggggggagagctgggtgtggtcatgagtgcctgtgatcccagcatttgggagcctgatgctgaaggaataggagttcaaagctttcctaggctatatagtgagttccacgagtctctggatagtttatacagccaaatcctgttgtagcaggggaggagggagggagacaggcacagagggacaggtggtgcaagaaggagaggaaggaagagaacaaaagaaagagacaggtgtggtttcgaatacctgttttctccccaatcacgaaggttacacacagttaggtttgtttaaaactccagctgtagagagggcttagtcactgaatgtgttctgctctaatagaagacccgagtttggctcccagcatctcatgtcctctagctaggcatgctggcacccgtttaatcctttatgacagaactgtgtcaggaaggactgagcctgtggctcttttgccctttgtagtttctgaggcagaggcagacagatttctgtgtgttttgaggccagcctggtctacagagtgagttccgagacagcctgggctacacagtaagcaagcgagggaggttctgtatcaaaacaacaacaacaacaataacaacaacaacaacagcaacaacaacaaccctaccaccaccaccaccaccagagaccaagcctgctctgtcagtcaacattttctccagcgcgggaatgagtattaaaaagaaaaaagacgccgggtgtggtggcgcacgcctttaatcccagcactcaggaggcagaggcaggcagatttctgagttcgaggccaacctggtctacaaagtgagttccaggacagccagggctacacagagaaaccctgtctcgaaaaacaaaacaaggggctggtgagatggctcagtgggtaagagcacccgactgctcttccgaaggtccagagttcaaatcccagcaaccacatggtggctcacaaccatctgtaacaagatctgacgccctcttctgaacagtgtccttacatataataaataaataaatctttacaaagaaaagaaaaacaaaacaaaacacaacgaacatcaacaaaaaaaagacagacaacattgtaacgtgaccccagtcaattctgagactgaaggcaaattttattttccaatccactttttgtaccattttaattacatgcaagtattttgggcaagcagtacaataaggaactaacaaagcagcatggaattgtatgggctgtgctgccatgacagttgtgtaaaagggctcgtcataaggaccaaaatatcttgagcccacttcttcgtccaagcccaaaaatcttgcctgaagcttagttctttttttccactctaagactaaaactcttgcctgacctaacttctatataacagcccaatgttagattcttgctgaaacttccttccttattatgccctaatgtccgattcctgcctgaagctcatttccttgtccttggccaatgtcagactcctgccaagtggtacagttcttacccaatgagccatctcaccagcccctactgtgaatttcttaaagattgtcctgtccctgatatgattatgtggcccttggcctgagagattccatttgggtttggtctgggggagcctggagatcaggccacatcagccacctctagatattttacgtaacaacagtgtgggtcaggcatttggccggccagacacttgtggcaagctggagcagggagggtgtgaaacttgcccatagaagacaggtgtgtgaacaagcctgcgtcagcagaatccaggagacctcctttcttctcatttttcctgttcagttgctgtctcagtctgtttttttttttttttactataacaaaatacctgaggctgagtaaatggaaagaatagaggaggttcacttgattctgggcagtccaagagcagagcagacctgtgacccatcctcacacagaatcctaatacggcagaggcgccccaagggaagacaagccagagtgataactcaggcctttcttcctcttcttataaagccattaatgccatcgcgggatgggggatcagatcctcatgacctcatccaaccttaattccccaaggccccatctccagatatgaattcaggctatgaattctccagcaggagaacttcagccagatgtggtgtgggtgggatatacacacaccgtggccactgctagctagtccccgaaaatcttgaggtacccagcctctggagaaagaaatctagacgagatgtttagctgagtgttttaggctttttcccatttcaaagacagatagtggcggcccaggagatggtcttgatatctgtccaggactctgaccttaggacagagctttggcagagatggctgtgcctggggctctgtggtcctctgtggtttctgatcaagccctgcggcagcagctctgcttcaccttcatgggcttcttcctgctggacccgccgcagcaggtggaagctcctgcccttcctgcctgtcctccttttcccaacccaaagccctcctctttctggctccttgtttctttcacactaaaggtttctttgttcccatcaggcctgacagttctgcatcgaagctgtatgttctcttcctcttccttctcctcctcctcttccacctcctcctcctcttcctcctgctcctttctttttccctttgcttttcgagacagggcttctctgtgtagctctgtcagtcctgggatttgctctgcagaccatgatgctgtccttaaactcaaaagtctgcctgcctctgcctcccaagtgcttggattaaaggcaggcagccaccattgtgcctggcttgggacttgcacttgcaatggcagacatgtgctttggtttggctgtctgtcaatatcttagtattcctggagatacagaggaaggactggcctttttactttgtaatgtgcccagccatccagggctcccttaccctgacccacctttaaagaatccagctgctagcttctatactatctgctctgtggctctcacaactcttggttctgccttttatgtctttatctggttccttctgtgtcgcctctctcctgtgctgggtagcaagtccctaagtgtagggtctgtctttcctcaccaccatgtgctggctgaaggtaggtaggctttgaatattggccagatgcatggatgaaaccagcaatgtgtaccctcttcagacaaaatctgcattggggggggggcgtagtaaatacttagacaaacatggaaatcaatggatgaattgttggtggatcaatgaatagacggatagacatatgagtaggtgggtggatggatggtagatggatggatgaatgaacaagtggttagatagatagatgaaacagagatggacagatgtaggttgatagatagacagatggatgggtgactagatggatggacagatagatggatgggcagatggaaggatggataaatgaatgggtagaggaatagatagatgaataggttggtggatattgattctctttggcctttccctggacttggttggtccttgagggctgaaattctcacacaactcacacagaaacagagtcaacaagcacatcacagggtgtggcaaaacagcctctgacactgcctttgttcagggacacaccatggtgttggctgcatgctgtggggtcagcagagtgggacaagacaggttcaggatcacaacactgcagtgctatgagacggagcgttctttactggtgtgagcccccttacccgcaggcctactcatcccactgcacaaacatccgtgttataatgaagaggacagctttgcctttctagaaaccacgttccaagtcccaaagcacactgggccctgagagttcaaagagaggactctgcgcgtgtgtcctgtgcaggagcagtccttagcacacatgggcacagaaaatgctgggatttcacagttgtacttgtgtgtgtgtgtgtgtgtgtgtgtatgactgtgtgtatggtggcatgtgtgtggttctatgtgcagtatgggtgttttagtgtgggtggtatgtgtgttagtatgtgtgattgtatatagtatgtggtcatgtgtatgtatgtgctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgtatgtggtatgtgtagtacgtatatgtggttgtgttgagtgtgtgtgtgtgtgcctatgtgtcacagagtgtgtgcagagatcagaggccaacattctggagtcacttctcctaccttatgagtcctaaggactgaactcaggttggctgaggctgaccttgacctcctgacctccttgcttctgtctcccaagagctggggccacaggctcctgtttccataagcagtttacacagcgctggagactgcgcctgggcttcctgtgtgttgggcaaacactaccagctgaaccggagcactacccctgagttttcttttggtgacagccaattgtacaatggttctgtagatcagaaggtgcagacaagagattcaacccaggtcacactgcagggtaacgacaggccaagattgtcaatccacagttttctaccccacagctagccacttgccatcaggcccttgctgacctgtctgtttcttgtcactgaccaagattttccctctgtaatacccaaaagttatatttagctgctcgccgggtgtggtagcacacgtctttaatcccagcacttgggaggcagaggcaggtggatctctgaggccatcctggtcttacagagtgagttccaggacagccagagctacacagagaaaccctgtctcaaacaaacaaacaaacaaacaaacaaaaaatttagctgctcataggccaagagaaaggcttaaaaatgaggcagggccacagccccatttgagctacttcaatcaaaagcacagctttttagggaaggtgactcatgcctgtaatcccagcactttgggaggctgaggcaggaaggtcaggagttcgaggccagcctcagttacatgagattctgtttgggcagtggggggagctaagggtggggtggagggtggagggtggagggatagcatttgaaatgtaaataaagaaaatatttaataaaaaatttcggggctggtgagatggctcagtgggtaagagcacccgactgctcttccgaaggtccggagttcaaatcccagcaaccacatggtggctcacaaccatctgtaacaagatctgactccctctttggagtgtctgaggacagctacagtgtaataaataaataaatctttaaaaaaaatttcaaaaaaaaaaaaagagtggggtggagagatggtggggtgggggccacagccattggtgtttgcacgaggcagaacaagacaccagggtgtgtagtactccatccttcccatcttttattcctcttttttttttttagaattatttttttaaagatttatttattattataagtacacagttgctgtcttcagatgcaccagaagagggcgccagatctcattacgggtggttgtaagccgtggttgctgggatttgaactcaggacctctggaagagcagtcagtgctcttacctgctgagccatctcgccagctcccatcttttattccttagtattaaataccgatagaggaaaatccaccagggtgtgatggcaaccaccgtagtcgagcctactaggacagctaaggcaagaggttagcccaaacccaaggctttgcctgggcagctgtggaaaaaccaaaaaagaatttgaccccagtgacttctcagacttgcgtgtttctgatgaccttggtggcgtggaggagtacagatggaaccactgggatgtgctgcatctgcctgcctcttcactttagggtagcgttggggggctgaggcagaagatcatggttgtaaagtgtcactaccaggtataccgagagtccgggatgtcaacataccataatgctgagatcaaatctctctgtgtgctgcaatttgctttctcctgccaaaaagaattcgggcaaattcacatcaagtttgccccagctgctgctgcttgatctcatggtccggctgtgtgaaccgctgtccctagaaccccccccccccccccccgtgaaagttgcaggcgcctttcacgctgtcagcaggaaagtaggctatcccccagaacattgagggagtgtcgggagttcggagataaaacctctctggctgccaggaagctgcagagcagggctcttctgtaggatcctgagctgggcagggagggctgttttgagtatcttcatttcccccccccccccgtttttgatgcggttactttaaattgggtcggtgggaggatggatacttttggatactggtgggtaacttccaaaaagaaaaacatttcccttacctccctccttctcttcttccctcccttcctcctttttctccttttttgaggaggagaagttaaaaccacgggggaaccttctagaaagtcctaaccgagaattttgctcacccgttttattttccttcaagtgtctaacatacgatctaacacatctaacctcggaacctgggcaagggtcccagttgtggaggcagggtgcttagtgccccctagagggagaccccggacttggagctcagcgcacagtgcttgaccactaagccacgccccagcccctcccccaatggctcatggagatgctcgtttggatgatcttcagatcctacttaagtacagtcctgtcccaaggattcacgtccatctctggtccacaccttcctcatctgtgctgctaaggagcggtggggatgagacgggggctcccgggcttgtccgcgttttgttgatgcgtaacaggggtcctggtggcccccgacagtaaaatcgcttgccaccaatcctgataattcaatctccaggactcaagtagtggaaggcgaggaccaattcctacaaatcggttttttttttcttttttcttttcttaaagatttatttatttattatatgcaagtacactctagctgtcttcagacactccagaagagggcatcagatcttgttatggatggttgtaagccaccatttggttgctgggatttgaactcaagacctttagaaggtcagtcggtgctcttccccgctgagccatctctccagcccaataaatcggtttctttatctccacacttgctgaggaagggccactaaccgccaataaacaaacaaacaaacaagtgaatgaatgaatagtaaataaataaataataaatgtaacttaaaaagtcaagtgcttcttggagggatgtcttaagaggctctgaagcgacctccctcttctgaacagttttcagtattttcctcggatccctcctacgggtgtccaaagtctggacggcagtgcagagggctgtggaacccacaaccgccacctctcgggaggggttctggggagggacgtgaaatacatccttgagtcctaaactcaaggtcaggggcagaagtatggcgcagggacagccctggaggaggcggggtctgggcgggactagtccctggggtgtgacctggagtggctgggagcaggatggaaggtttggcccatggggcgtggcctaagcggatgtggagggcgtggccaggcaatcagcatgggtgggatctgggtgcccggtgagaggtgtggcctggggagggcgtggccaggcgggccttggtttgggtttcccagagtctggaacagttcgggatggccggggaggctcgctgtcccgcgacccacagctgtcacaagctgcggccagggcccctcctcgaggacgcctcaacctccgcctctggtggcgagctggtgaccctgctgtgccttgggagccgggcttgctcgcttcctgtgattagggggtgcaaactgcacatcccccgccctgttgggattggcccggtaggctgggcaacatgagccctgccaaatgcaaggtctgtttccctgagctcgcaggaaagtaagtaagcccgcgattttaataactgcttttgcaaacttaacgcacccctctccgtccaggtcaactgtctgccccttagcacctcgcctttcccccttcttccgccccaagagatgcgagcttagcttggccgctgcaggaagaatcccaccgctcaaacttgcggcctaggtgggcaaccagtgacgatgtttggagagctctgcccaccacacagctgcctcaagattgttccctgggacgcactactcttccctccatcttcatccctttggccttgagaaaataacgtttgtgggaggcaacacttattgaggctgaagccttgggaaaacccagacatcctgagcaggctttgtatttgaggtcactttctgagcgtaccccactgttttccttttctctttcattttattgcactttaaaccactcaccaaagggatgctgtattcgctgctgagaattcagcccgaataagggagtgcggtacacatttataatcctagcactgctgaggcaggaggattgagttaagaggccagcttgggctatataggaaaacccacacacgtaaagcccctccccccccaaaaaaagcccaaatgaacaaactaaggaaattataaacacgaagaggagtaaagatataattccacctggatcaacagctgatacttgacaaatcttgttttcagagcagatgtttaatttataaaattgaaccatatttattgtaacctattagtctttttaaaaaaatttattttatgtatttgaatgctctatctgcatatacacctgcatgccagaagagggcatcagatcccatttcagatggttgtgagctaccatgtggttgctaggaattgaactcaaggtcaggttaggagccagtgctcttaaccgctgagtcatctctccagcccctttttttttttttttccttcttctttttcttttctttttcccaaattggctctgcaaattatgagtttatctgcatttatctggcctgagggcagtggttcttatgcttttaaataattaaaaacaatcaagagaagaacactgttcatgtaaaaaacaaacaaacaaaactaggaggaattcaaaggccagagtgcataaataaagttttattggcacacagcttcactcgctggtttctgggaagcctgtggcacatcttgctagaagtcctcagtagtgacagagggcagactttataacacctgaagtatcagctagctgtgacttgccatgcttgtaggtgtcagccaatctcacatgctacaacatccaatctctctgcctccagaggattgggattaaaggtgcaccactgcactcttacttagcccaggctggccttgaactcaccattccacccaagggtaccttcaactcctgctgctccttcttcctctgttttctgagtgctgggattacagatatgtagtccctgtttaaaaaaaaaaaaaaatatatatatatatatatatatatatatacatacatatatatattctgagtgctgagatggatattatacacacacacacacacacacatatatatatataaaatgtacatatgttgtatagatatatagcctgctgatgaagcccccatgtcagcctagctcagggtcagtgtgctgttttcctaaaaagccaaatagtaaatactttgtgacaatacagcctttcacagctactcactgctgtttcctgtggcagtagctacctgtttatatgggactggctgtgttccattaaaggaccttgaaatgagccgtttgtatgatttattgtgtatcataatatagaattctttggaccccccctcccccagaaccacttaaatctgtttaaaccattcacagcagattaagatcggcccagggactctgattgttcacccttgacctggtatcattccagaaggcatccggaggttgtatggcctgagaaattcccaaaggttgggctggcaagccagggcagcagacaattcctggaatctacccagtggaaggggagaactgacttctaaatgttgtcctctgatttctttccacatacatgcagcccatccacaaataagttaaattaaaacattgaaatagaaattatagaaggtctatttatctggtatcatagttatatgtaagatttgatttatttctatgtgtgtatatgatgtgtgtgtgtgtgtatgtgtatctgtatttgctgtgtgtgtgtatgcatgtgcatgcatgggtgcatgtgtgcatgttatgtgcatgtgcatgcgagagtgtgtatgccatcagaggccagaagagggtgccagatcctctggaaatggattacaggtagctgtaagccacctgatttgagtgctggcttcccaaaaggaacagcaagctctctttaacagctgagccatctctgcagctcctgggatcccagtattgagttgtctgtaggaaagtaaattcagtggcttcccctggctccaagtcttctccctgcatttccattactgacaacagaaactcagcactcacactgccttccacccatcacctggtggtcaggatggtagagggcaagggatttgagtgttggagaacgccagggccctggacagggaggcagctgggacattcctatcagggacaagtctccttcagtgtacagcctgtttatccttttccagattctttgttcttcggtcctaggacagtacccaaggtctgctgcaccataggcaagtgtcatattgcttagtgacacacccacctccctagatgcttcatgtctgcagacttgcctgacccaccccgagaatttgttttgttgaaacagtctgtctatgctgctcaggctggccttgaactcatgatcttccctcctctgcctcccaggaactgggatttcaggtgtgcactaccacttccccctttgggtcccctgaatatttcatcctatgagaggaggcacggggtgttgtaggggcatcttgaggtcacaggggcaaccgattctacatcagaaacttggggcgtttcacagctggagctctgctggtgtctgtggccatgctgtgtatttgcacagggttgagcaacgtctctgatctcacctccatacccacactcatttccagagacgaccctgcagtgcttcgcctttgtatcctagtcaatctttcctacctcagtatgaaaatctgaggtgagatagagttgggttaccagcccagctctgctgtttgtcagctgcgggacttgaggccagaggacctctctgaacccctgtctcattattccgagcaggagatggcagccttttttatccggagcagtcgcatcgagaaggaccagtctgttgtttgcccttgaaaacattgatttccttccatccccaaacagcgctgcccaggtcttatgcccaacagctgactgggtctggtgcttggcagctccgttgttgatcgcttttcagagtcatttccaaagccaccgtggaacattttggccctcgccctgtccttcctccttccgcctaaggtcagggcttagctctgggccagaggcacggcacttagcaaaggttctcccttacttggctccagtgctgggggacggtcgtctgtctggagccaatgttggttggcctccagcattgtcagaaaagaatcaaaatagtccagtccctggagatggagcctgagacaaggccttccccacagtcttgtatgtgctctgggtagttgctggcttcctggtgaagtgattccattaccgacctaaaaccagtgtggtaccacagatggttctgggccttgaaatggtgattttcttttccatcaaatcgtataaatgtgtctgagagtgggaggggtcagactttctgacacagagaggcatcagcctgtcagggaaagtcacagacaggagagactggtgttcagatgggggttttgtggagtgggctaagcaagtggcttgttgctgctcctcttggaccctgacccagctggtgtggctgctcattgagggtgtaccacgcgccacaccgagccctctatgttctgtctatggatggtccaggccacctcacttaatcctgagcaagtgtgcagccatattgaatgtggtgcctgatattctccccttattccaggtgagggagttgaatgcttcaaagggaagtggagtggctgtggctttggaaaccagagacctggctgaggagaggaacgattactactgtcttctccctggggtcagcaggacgtggtgtgtcaagagacaggatgttctcatgaggggacatttgggttgagaacatggctcagacagtatttcaagttggggatctgagtttggttctcccaaacccatatcaagataaatgtcgccgggcggtggtggtgcacgcctttaatcccagcacttgggaggcagaggcaggaggatttctgagtttgaagccagcctggtctacagagtgagttccaggacagcgagggctagacagagaaaccctgtctccaaaaaaccaaaaaaaaaaaaaaaaaaaaaaagtctggactaggaggtggaggcaggaggatgtgcggaagttaccaccagccagtgcagccaaatcggtgagccccaggctagtgagagattctgtctcaaggggggagggtatgtggatggcattccaggggatagcacccaaagctgtcttctggccttcatacgcatgttcacacgtgcacacacatgaacatacatgaacacacatgaacatgtatgctctgtgagaactaaaagggaacattcacataactagtatctcaagcaaaccccgggacaccgacaatgtaagggccgggatggagagccatgctgcttgggtggttaggagggtggtaagagaatgagtaggttagtgggctagcctcagaactgcaacaaagcatataatgtagtaggttagcctctgaacttcaccgtctaaacgtcagcatatagtagagagaaaaaaagaggtaaggagatgtttgagtccctggtgtgagtttctggatggagaaggtggggtttggggctatatctcagagttcttcccgtgtctgtgtgaattgggtttcattcccagcaccataaagaaacaggacaccagactgagaggacctgacaggcccacagcctcactgacagagacagacgtggctgtgtacaccatgacaccatcagatacaggggatagaagaagacgaagctttgagatatgggaaagccaggccgtcaccaaggatcaaagattaaaccccactaaccaagcaaaaacccttagaggctctgacaggacaatgacacaggcttcgaaaactcagcacagatcaaactagtgggctgaaccccagggcagaaaaaaacaaaacaaaacaaaacaaaacaaaacaaaacaaaacaaaacagaacaaaacaaaacaaagcagtctccaaaaaacagtcaccaaacacacaaggtggccaagccttccccctcctcttctccacttccctagctttctcagaaagccacttgaggatgtcttccatgaaaaccacagggcacaccagggaggaggaacagacagacacagcagagcatccagcagatagatagtccagggctcctggcagtgataaccaggaagccagggagagtcgggataccatcattgcacgctgctgaatatacacagtgtctgatatgaagctgccaggggtgtgctccagcaaagcaaggaagtacccccaaaaagagggagccccccagtcaccccaaattaggatcctgctctgaggaaagacaaaaaagaaggacagacatccatggttccgaggccttaagaacagccattcagcagtgtgtgtctgtgtgtgtatcagatgtagaacactgcagatgtgaaatgccagagccaacagcaattttctttcacgggagttacaggggaaaggggcagggaccaccctccgcactgtgttctgatgtgtgtgtgtgtgtgtgtgtgtgtgtttaatgatttgttttgcgcatgtgtacatgtgtgtgtgtatacatgtgtgtgtgtatatacatgtgtgtgtgtgtgtgcatatgccgtggtgcccgtgtggaggtcagaggacaacttttaggagttggttctctcctcccatcacgtgggtcttggggattgaactattgaactcaggtcttcaggctcggcaggcagccagtgcctctacccacttagccatcctgcctctctggtcacgtgatttttcgtttgtttttcaagcttttactgaacctcagcagtgagttgtcacccatactgaccttctcgagaggtttcttcttcttcttcttcttcttcttcttcttcttcttcttctctctctctctctctctctctccccctttcttttatttttatttattttgttttccaagacagggtttctcttgtgtggccctggctgtcctggaactcactctgtagaccaggctggcctcaaactcaggagatccacctgcctctgcctcaagagtctatttatttttattatatgtgtatgagtgcttgcctgcacatatgtctgtgtaccatgcatgtgatccatggaggtcagaaagtgggtgtgtgtgtcagactccctggaactggagttacagctgggagccccatgtgggtgctgtgaactgagtcctctgtaagagcagctagtgctcttagctggcgattctctccagggagaaagatttgatcatgcaacagggatgagggtcaccacagtctagagggtttggtgggtccccttcctctctgcgtttcccatacagacacgcacaggcacactgaccaacatgggaagattgcctttggctcagaggctcccttccgtctctatcccaatccactcactctttccttcatcttagtctctctggggtggaggttgggggtgaggtggggggggggttgggggattagtgggttgggggtggggtaggcccgtgatcttcagctagacctctctggtgctagatcaaccttcccacatttccaggcccagggtggggagggagggtgtgtttggatgttcaggaaggaaagcaaagatgtcacaaggacaacttctgtactgtgctcttttttgtgggggtggggttgttttgttttgtttatgtatatgtatacactgtagctgtcttcagacacaccagaagagggcatccaatcccattacagacggttgtgagccaccatgtggtttctgggaattgaactcaggacctctggaagagcagccagtgctcttaaccactgagccatctctccaacccctgtactgtgttctttaaaacaaaagttttgtaaaatatattcatggaagctacaggggctaaatttgacaggtggtagatgaagagtcagagtgtgtggatcccccttcctgaccacagaacacctgcccctgctgtaagttcccaaatcaggaccatgtcaatcaagtaagggctgagttatctcagggcagggacagtggcacaggcctcctagggtagcactgtctggccttgagtcttcttgttcatccaggtttgtgtgtgtgtgtgtgtgtgtgtgtgtgtacgtgcgtgtacacagggtatttcagggtatgtgagtgtatgtgaatgtgtacagggtgtatgtatgaagtatgtgagtgagtgtgtgagcgagtgtgtgtgtgtatgatactctctggccactggctttgcccgtacagctccaggctcctgtcctggggaccccaggcttcctccctcacggctgctatttttcctttgcaggcccagcatgtctggactccatctggtgaagagaggccgagaacacaagaaactggacctgcacagagatttcaccgtcgcgtccccagccgagtttgtcactcggtttggaggcaacagggtcatagagaaggtagagacatgtcttataggctagtgattgagggggccgggcccttttcttcttggaggtccagcatcaggctttttcttcccacttcagaggtcgaggacgcctcctcttgggacatctgtttgggcaatgagtgcttgcctttgggagctttttacacacacacacagcatgggtgaattagcccattcctcagaaatggagactgagtctctggccttgatcaagaggctcctgagtgctttggggaatggagccacttcctgggtcgacggtaggagagcagcgaagctgctgccagccactttcagaggttagggcttcttagaggagaggagaccacgaactacagtgagcaggtcccttggttatgtctcctgtgttcatgacaagctgtggcccagaggtgggatgcaggttgtccaaggttaataagaggagtcgaagggatttgaacgtggcttgatggttcctccgtcttgctccaaacactcagggtctcctgggaaagaacattgcttttttttaagatttatttatttttttatgtgagtacactgttgctgtcttcagacacaccagaagagagcattggatcccattacagatggttttgagccaccatgtggttgctgggaattgaactcaggacctttgaaagagcagtcagtgagccatctttccagtccctgttttggattttttttgttttgttttgtttttttgttttgaattttgtgtatcccaggctagcctcaaaccccaaggataaacttgcccttgtgataatcccacctgtacctcccaagtgtgtgccatgacggccagtctatgcagtactagccactgaacccaggactcctccacttctagactctgtattttggactcattaggagactgttttgctgcggcggaccgggctcagtcagccccccttaatctgcagaaaaaaatttgggggtcccggtttcagttgggcaaagagttggtgacaatattaacacaagggagtgtggtatctgaatgtaatttgtctcaaagtgagcagcagtcttataagtgacttttacacaaaacagggaaatgtgtacttaaaagctaacaggaaccagctgggataaaattcaatgttaacatctgggatcaaaagcagccccacctaaggtcagcttaatcttagaagtcaggggtaagggcatcgtgcccttgccgtagttcctattctagtctattgtatagtccaccttccccataggccattgtaaattcctgtgtatgggtgtaactcagctatctatagttctaagtatctactctggttcctccctagaccccaatcttccttcttcctagataatggtaaatttttgcatatgggagtagcttgccctgagatttctaactcttatccagtaaaatactgtaagaaagcatgcaagaccctccacattattgcagggacaaatctggggcattctagctatggggatgccaaatttccaggggaccaagtttccgtgaacttttcacctctggactatatccaggtttttggggcctgtcacacgtgtcactactggaatggatgtagcgttttgcagccggctccactgtggctggtgtttcgtcctcagaacatcacagctcactagcctcaggtagcctctgcccggtgctctcacactttctgacttagtagctgatcccagcttgccctcagtactggagattcatgagaaagcctgtacctggaaatgagagtggagagatctagctccccccaatggggctccaagaatgtgtcttcccttgccacctccagccctctgaaccaagccttgctttagcaatgagaaagccacgttaggctgtactcattccttcccagtggtggccctctccagtgatgctcaccctgagtgattctcctccccagtggtgctcctccccagtggtgctcccagcagtgatgcttctccccaggggtgcccctccccagtcgtgctcccctgcagttttgcttccctgcagtggtgttccccaaagacttagcagggccatgcaggagagccaggagccttggtcaaggcctgaggtcacagtgtgagcttgactgggcctgagtttccccatctgttaaacagaggcagtcacatcccacacttcagaggaggccaggccttagcagcatggccagggttgtgtagcagtgggagagaacacaggaaggaactgctctgtgagtcagagcttgagaccagaggcctaattacctgtggagattgggtattatttatttattttaaagatttatttatttattatatgtaagtacactgtagctgtcttcagacactccagaagagggtgtcagatctcattacggatggttgtgagccaccatgtggttgctgggatttgaactccagaccttcggaagagcagtcgggtgctcttacccactgagccatctcaccagcccgggtattatttattttgagacagggtttcattctgtagccaggatatctgtgaccttgaagtctttcttcagtttctagacagattctgcctggattctttttctttttctttttttctttttttcttttttttttttttttaagatttatttattattatatgtaagtacactgtagttgtcttcagacacaccagaagagggagtcagatcttgttacggatggttatgagccaccatgtggttgctgggatttgaactctggaccttcggaagagcagtcgggtgctcttacccactgagccatctcaccagcccccttttttttttttttttttgagacagggtctcactgtgtagccctggctgccctggaagtctctgtgtagaccaggatggcctcaaactcagagatctgcctgtctctgcctcctgagtgctaacattatgcccaactcaaaagatttatgtattctatattatgagtgtttgtcagcatatgtatgtatgaatgtatgtatgtatgtatgtatgtatgtatacatgtatatatatatacatatatatatacatgtatatatatacatacatatatgcagtgtgcatgcagttttctcagaggacagaagagggcgctagatcccctggaactggagttacagatgcttataaaagatctgctgtgtaggtgctgagaactgaacaacccaggtcccctgtcagagcagccagaggcctaccgagccatctctccaggcctgagagatgctgatggtctttctttagtgctgggggattgtcttagttagggttttactgctgtgaagagacaccatgaccaaagcaactcttataaggacaacatttaattggggctggctgacaggtccattatcatcaaggcaggagcatggcagtgtccaggcagatgtggggcttgagaagctgtgagttccacctcttgttccgaaggcagctaggagaagactgacttctagccagctcggatgagggtattaaagcccacgcccaaccaaacaaaagaaacccaaccaaacaaaaatgtatagttattgctaaaggtttgtgtgtgtgtgtgtgtgtgtgtgtgtgtgtgtgtgtgtgtgagcacattctatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcagcagccattggcaacacacacacacacacacacacacacacacacacatctatctatctatcttggaatttgctctgtagaccaggctggccttgaattcacagagatccttctgcctctgccacccaggtgctcagtgatgcttttaaaaataccaaatcagagcattgacaatgcagaagaaaccgaagggccgtttgaagtacgggtttagagagataggttttgagcccctgctctgctggctctgtgacactgaggcgatgtctcagctttcccggtgtctccctcaggtgctcatcgccaacaatggcatcgctgcggtcaagtgtatgcgctccatccgccgctgggcctacgagatgttccgtaatgaacgtgccatccggttcgtggtcatggtgacgcccgaggatctgaaggccaacgcaggtacctgaacttgaccactcggctcaactccatgctatccatctcagccagccctcacctcctccaccctgcccagacagatccctcctggaccctggagctgtaggctctctttcactgtcttcttcttatgtgctcttttgcatgccggcatgcatatcatccattttaaaattttaatcaccacacagcgtagcaggtgtcattatggcatcttcaaggagaattaatttttgttcattctcctttcccacttctttctcatccccacaacccccctcacttccattccccataacagtttctttagctgtctttcctgcagccaggtgtgttgttttatttgttaatctctgtggcttattttcctttggtcctgttgaaaccaaacatactgtaaagtcagcaatttgctttttagtgcttttgtagaccctcccccgctcagagcccacgatgctcttcctggtgccagcaacctcatctttgtccgcatccctcaggaatacaggctcagctctgcacagacacagcctgcttgttacttggtcccatttaacagataccacagtagaggcacaggaatataggttcattgctggcatagcagcctattgccagcagggggcactctcctgtggggtcctcttgtcacctcacactgacattctccacatggtttggctctggttggctccgatttgtataccttgccctctaagtctgggcagacaaggtggctgtcaggctgtttcctagatcctccccagtgcctgatgctcactacttggcagcatcagggaggcgtggctttttctggctttcttcctgtcttgggattccactgcagacgttttttcaggatttgggggaattccagtctgatacaccaaccttcgacttcgcattgggtttggatctacggggcagacactgcttggcgatgtccctccccgttaccctttgctctttatcgtggatggatttctttttttgtgtgtgtttttgtttttgttcttttgatttttcgaaacagggtttctttgtgcagtcctggctgtcctggaactcactctgtagaccaggttggcctcaaactcagaaattcgcctgcctctgcctcccaagtgctgggattaaaggcatgcagtaggatacccccacatatatggagccctaggtttgaatcctcataacacacacaaaaaaaaacccagacgaagtggcatattactgtaatcccagtccttgagaggcagagttcagaagttcaaggtccgtccttgacgtcatagagttgaggctagcctgggcttccaagagacccagtgatcaaactaaccaccaaacaccactttatttaacaataaaacattaagatgggccttaagtaggactaataatacccatccccgccttttcccttttatcctaaagcatagccattgccataaaagtaaaactcttgattttcttctgattttgtggacgacacccatggtcaccgcacagtccccagggctgccctcaacggcaggatgccttgcaccttaccagctcttgtctctctgcctgcttcttcccaccctctcctgtttaactgcagagtacatcaagatggccgatcagtacgtccctgtcccaggaggacccaataacaacaactatgccaatgttgagctgatcatagacattgccaagagaatccctgtacaggtgatggttcacagctccccaggggtggccacggggcggggtggggatggggatggcctgatgggacacagcagtgtgctgggtgcaatgcagcagcaggtgggggttgggaagatccttgttcacgcctctctgtgtttgcaggccgtgtgggctggctggggccacgcttcggaaaaccccaaacttccagagctgctgtgtaaacacgagattgctttcctaggtaacgtgtgccctccgtcggattgggatgtgcggagtcagagggtctttcttgtgctagagggtgctttcctcacggcgcaggatcagtttgcttccttgggaggggaaggggtgggaggccctgagcgcgtgttaacctatggcaacaggaaccactgtggttatcgaaatggagtgatgctgtgctgagtagcacctgtgctaagtttctgttggtattaaggtaccagccaagctggcccgagcatcacgtgtctgagagggccgtatctttgggctgctttttgcaggaccagagcctcctcactttttgttaggtaaaaatgactctgtgtctggtggcagtggcggtggcggtggcggcggctctcgggattttcacttgtggacgcattagacaatttggtatgcacacagttggtcctgtcacatagggcctgctcactgtgccacgcgcgggctggctctttgagcctttagtgtgcatccttcctgcagatgcttggttcctcccaatgtgagtcttgcatctgctacagagctcagttttcggttttcgcttggataaggtccaggtctagatgctggaagctgaaagaaggccctgagcgagggagagcaggcagagagcttccctccatctccttgctctcccgagtctggccaccataccgtgcacccggtcaatgctctgcctgtcagtggctgaccctattccatcctcccttcctgctacctcaggtccccccagtgaggccatgtgggccctgggagacaagatcgcctccaccatcgtagcgcagacactgcaaatcccaaccttaccctggagtggaagcggtaaggggtgcagaccttcggggtgatgggaatgtgttctgaaaaattcttttgtgtggaaattttagacaaatgagaatgtgactaccttatatggagcttcgggcatatactggtggtggcagctcatgtctgtaatcccagcgatcaagaggcttgggttgcacagtgggtctcaggccagtccagggctgcagtgtgagagcctggtttaaacactatcaccacctcatactcacacccacactcccacacacacactctgacacacacacactttaacacttgcactaacacacatatatccactaatactaatatacatacactaacatacatacatgtacatacacactctaacacacatacacacactaacatttgcactaacacacattcactaatatacacactaacacacacatgcacactcactcacacacactttaacagttgagctggagctgcaagtgttcataaccctgtctatgtttcttaaacattgactcccattcagagtcctgagacactggagtgtggccgctgggctgtgttcctgctgtcctgaggaggacacaaccctctttgtccccttcaggtctcacagtggagtggacggaggacagccggcaccagggcaaatgcatcagtgtccccgaagacgtttacgagcagggctgtgtgaaggatgtggacgaaggcttgcaggtagtggcagatgtgcagggtctgcgtggtcaccatctgatacaagcttccctccgccctggggttggacttgttctacctctaaaggggtctgtctgtccttttcccccaggcagcagaaaaaataggatttcctttgatgatcaaagcctccgaaggcggaggcgggaaaggtatccgcaaggctgagagtgcagaggacttcccgatgcttttccgacaagtgagtgcttcctgccctgccttccctgtctttggggttgcttccgtccattcttggctgatggtttcgattagcaacatctcctaaagccaggtccacgtttgcaggtgctgggttttgttggtttatttgttgtttgtggtgtgtgtgtgagtctgagtgtgagtgtgtgtgtgtgtgcatgcgctgtagtgagagtttgtttccttaaaaaatacagaaatattataagaacacactttcattttaatcccgggtgtgggctgtggggttgcttcctactgtccacagcagcggactatgatttgcctcgtgcaggggcgtggtttcaccagctgcacatcgtttctgcgattgtgtgatactgggaatcctgggaacttttcagagggtctataaatgctagcccccccccaagggttgttgtttgttgacttttgttaagtagtcgagtgcaaagaaaaaaacaagaagaagaaatggggtatcttgacagtgaagattaaacttgctccaaggaccttgatgcccctagtcagcaggaagcagtctaacgatgatgtgggtcaccccctttctgacccttgactttacttagaatctctttctctcttctcttgtgttagggggttggaagggtggagaagggtggaagaaaaaaaatcacccacaaagtagccaaagccagctacaggacaccctcaattgctggtcctccacctgtttaagacaggctctcttgtctcaatatttttgctgctgtgcacactaggctaggtgcctatgaacatgagagcttccatgtatcttcctgtcccaggatgctgggattacagataagtgcactagtgtttatagttctagggtttgaactcagtttccccacaccactgagccaccctccccctccccagctcttttttttttttgggtgggggtgctgggatggtaccccaggtctctcaccttctaggcatgctctctgccagtgagccacacacccaccttgtggtgtattctgaagcggatggcacagcgctgctcacagcccacagctcctttgcagccttccttcagataggcaggtctgtgccttggggtggctccgaaacggtctcctatttgcacagggtattttggggttccttttaaagtgtctagatgctcggtttccatgtgggtatgatatctgtgttgcttttctctgccaatgcctttgatcggcagtgtgctcaagtctggtactcccaggccatagtcccataagagatggtgtgtatttgacttgtactgataggccgcctttttccagcgaggtgtgcaggagacagcttgtgagccctaggcaagcactgtaccagtgagctacagctcagccttcagctgtgtgtctccgtccacctccctggccacgtttgagagaaggattttatgttgcttaagataactgcaacttttttttccccttaagttttatgtgtaggggtgtccaattagggttttacagctgtgagcagacaccatgacccaggctactcttacaaggacaacatttaattttggggctggcttacaggtttcagaggttccgtccattatcatcaaggtgggaacatggcagcatccaggcaggcatggtgctggaggagctgagagttctacatcttcatctgaaggctcttggcaaaatactgatttccaggcagctagggtgagggtcttaggcccacttccatggtgacacacctactccagtaaggccacacctcctccaacggccacacccactctaacaaggccacacccctccaacaaggccactcctattccaatagggtcataccttctaatagtgccactccctgggccaagtatatacaaaccatcacaagggctgtttcatgtgcctgtatgtgtggcagtttgtctgtgcaccatgtgcctgcatggtgtccacagaggccagcagagggcctggaactggagttagaagcgtgggtacaggttacactagtccacatagtccaaggccagctagagttacagtgagactctgacaacaagagaagcttcctggaaagggacttagttaagcctgtacacgttgtatgccctgacaatacactttaagaactttctagaaagcgtttctgtggtcgcgctctgggcacgtgtgagtgctatatcccgaccgcagttcctctgctgtgctgtgcctgctgagctgagcagaacctcaggaagtacgtctagaaactttgaacagctgcagggatgggtcccatctctctccacccaggttcccgcagcccagaggtggatgtgggcatgttttgtctaaagaagtgttctatgtactatagaatgtgcggaagaaaagtagtttgcacccataccccacccctctgtggatctgtatttgacagataaaactgcacatgtttaaggtgtttagtgtgacatcccatcctgcatatattccctggggtgattctcacggccaagtcagtttacagacatgtcacctcacatgtttatgtgtgtttgggaagagtgctgagatttatctgagtaaatttcaagtacataatatgttaattacctgcaccatgctgctgcactcccagagaactaaaatcagtggggttctgttgtttttatgtttgctgtgtagctcagcctggccttgaactttccgtatagctaaggctagacttgtgttctccatgtagcccaggctgaccctaaacttagcacactcttcctgcttcagcctcatgggtgctgagatttcaggatctgagcagggtatggacattgtatgctatgtaactaaggaaatggtgccctgttttatgtacggtgtttgactttaaaacgatgagaaagcataccacgtgtctgttggaattaaaatgaaatcgaggagggagtggagtatggggtagcccctgcccatatcacgactattgttgaacttccagaagcttccagagctggatcctctctgatccgacaccacccgtgcctccccaacaggtgcagagtgagattccgggctcgccgatctttctaatgaagctggcccagaacgcacggcacctggaggtccaggtcttggcagatcagtatggaaacgcggtgtcactgttcggacgggactgttccattcagaggcggcaccagaagatcattgaggaggctccggccaccatcgccgcgcctgccgtgtttgagttcatggaacaggtaggtgcctttggaagagtgggcttagtcggcagacctggctacaggcatggtggctggaaggtggtgatctaggcatcacacagatgtgtctggtcgctgaggattgccatgtggcaggtccttagtgtgcccctggaaagggaacaggtgctgacattcatggtgacctgagattgccgttggcctctgtctctgcagtgtgctgtcctcctggccaagatggtgggttatgtgagcgcggggactgtggagtacttatacagccaggatggcagcttccacttcctggagctgaacccacgcctgcaggtggagcatccgtgcactgaaatgatcgcagatgtcaacctgcctgctgcgcagttgcaggtgaggaccttcgaagccgggccccaagcatgttgtgtgagtgtgagcacatgtgttgtgtgtgagtgtgagcacatcatgccgtgtcagaagatgttttgtaggttctcttcttcccccacatgggtcctgaggatttgaactcaggtcatcaggcttggcagcagtcacctatatcagttgagccatctcactggccccaaaatcggtgtttttggcattcagattgaatgtccatcagtatggatttgctcagttatttcttcctggttcaattcacactaatttctgcagaacattctggcatccttttgttttactgaattccaccacatgctcacgtgcaccaagtggaggccgtgacatgcctgggctttccttgttgctttcatgaagcctccgtgaccatccagccagccttgtggtttctctctgtagctccaaggggctagcctcaggcttaatggcggagctcctcctgatatgatgctcctagttgagtcttcctttgttcctgccccccccccccccgccccccaggctatccctgtgtggcctggaacttgtgatcctcctgcatcagctttctaagcactggacttcaagtgtctgataccgggatcagctgactttctttctctcctctcctgttcccctgtgcatagcactgtctagacactataggctcagtgtgtctgagagtgttaactgagcctcctcttcttcacatccactgttataggctcagtatatctggaagtgttgactgagccttttcttcacatccctgttactcttcatgtctcagggccaggatcctagcacactaacctgtgcgatgggttcttccttagatcgccatgggcgtgcccctgcaccgactgaaggacatacggcttctgtacggagagtccccctggggagtgacccccattccttttgaaacccccttgagccctcccattgcccgaggccacgtcattgcagccaggatcaccagcgaaaacccagatgaggcaagtgtgggtccctgtgtctacaccaactgcagacttgtggcgaagggtgggccctggtctttggtgtgggtatgctggcactcagaattctcagcttatacccaagaaactctgggtggaagctattggtcatagctttgggcttcagcaagcacttcacatggcccctcactcccatggcctcactgggtggtggtcatgttccagcctgccggggtcaggtaagccctcccaactcgccacacggttcccatctttggcttgtgtagccaggtttggagcccaagttctggggtttcttggtttctgtgctctttgctgtagtcctgtgttttagggagcctgtgggaggtccccttgaggcttattcttcttccttgggtcttgaaaacaatttagctggcttcattgcttccaaaccaacccctcattgttctggggctcaccagtctcttctggtttctgtgtgtgtgtgtgtgtgtgtgtgtgtgtgtgtgttatgagtacactgttgctgtcttcagacacaccagaagagggcattggatcccattacagatggttgtgagccaccatgtggttgctgggaattgaactcaggacctctgaaagagactgctctcaactgctgagccttctctccagaccttcctgttttattttttaatcaaagattgtgtgtgtgtgtgtttaaaacaaggcctttctataataactctggcctcagactcacagagatatgcccaattctgcctccagagtgctgggattaaaggcatgtgctaccatacctagtttatttaaaattaatatataatatatattatatatatgtgtgtatatatgtttatatatatatatatacacacacacacaatatacatacacacgtatatacaaatatatgtatatatgtgtgtgtatatatatacatatatatatatatatatacacatacatatatgtgtgtgtgtgtttagtttatgcatatgagcgttttgcttgcttgcatgtgtgtacaccatacgtgggcctgctactggaggagagcaaaagagggtgttggacttcctgaactggagtcacatatgttcatgagccaccgtgttggtactgagaaccacatccaggttccctgcaggagtgggcagtgttcctaaccactgagtgtccttcccactcttcacttacatttttagctatgaaaatgtccagtctgtgagtgctgtggggatcgaacacaggtccttctgcttgggaagtcagtgctatttgcgggactgggctatctccccaaccaagtgctcagagaactgacttctgtttctctttttcctctgtctgggctccagggctttaagccaagctcggggacagtgcaggagctgaacttccgcagcaacaagaacgtgtggggttacttcagcgtggccgctgctgggggcttgcacgagttcgccgattcccagtttgggcactgcttctcctggggcgagaaccgtgaagaggccatttcgtcagtatctccggttcccttcccgttcctccaaccccgcttcccagttctagaaacattcagaagtacttgtgtataggcctgaatacctgagtttgaccccagactccacaaggcagctggaggtgcatgcacacgcatacacacacatacacacacatacacacacacatgcatgcacacatacaccaaactcctgtgacccatttatacttgcaacagtgtgcatgcacctgcacacacacacacacacacacacacacatgcacacatgcacacatacaccaaactcctgtgacccatttatacttgcaacagtgtgcatgcacctgaacacacacacatgcatgcacacatacaccaaactcctgtgacccatttatacttgcaacagtgtgcatgcacctgcacacacacacacacacatgcatgcacacatacaccaaactcctgtgacccatatatacttgcatcagtgtgcatgcacctgcacacacacacacacacacacacacacacacacacacacaggtccttccctatgcatcacttactgttttaagtactgaagttcaagaacaattctcttcctctgttggagacctgtggtgaagagcagggagcccaccaggcccctgggtcttgagtgtgcaagagagctaacttcaaagagaccctaaaccattcaaagctgtctaaacggtgcccagcactcggctcaggagagggtgggggcacctttaacacctcatagtttgcacaccatctttactccaagactcagtttcttctggggttcctcttcctccctgctctctactccacgcttgtgacatggcctgtgatccctgcttagcaaatcctgtcacagttaaacagactgagaaactcatattaacccaatactccccctgtctttcctcttaacatctccctgcctctacaccagtccaggaaggtgaaacgcactttgtgttgtagttaagcatcctgtgctgccaggcaaccaaaccactcttcagagcgtaaagagcccaaaggcatcgagagtatttcatttaaaaaaatgttagactctggtctggctgtttaactgtgaattgatttagggtgagagtttgacagttttgatggtgctgtccctctgtcagcttaggctaattcattttaatcgtgttccgtggcaaactgaggtcctccgggaaagtggagggagacttgcaacaaatgagacttaattaacggaaggaagtgggtgggcccggcatgttcccggagaggctcagactgtggcgctgtctgcagctgctacagacttagagaaactccagcttatactgctgacagagtctagcagaggaaagcacttgccggactctgtgattggctccctgatccgtgctatagacaaacccctctgtggcagtcagtcttcctcagttgcgtggccgagttacatacagatttaggtcctgagactgacctgtggcttcatgtgacctccccatgacacacctggacagagcagccaggggacaggcagaagtggcttttatgagacaggagatgggaatagaccaaggggaggccgaacaggcgctcagtcagagaggccccacccctttcttcgaatcattacctatcaggatgatctaaactctgagacctgttgactgcaacggcattatgtggagcatccctcaagtactgcaggtggcaaggttatcaccccatttttcagacgaggtaactgaggccccggggtggttaagttactcaagtgaggtcactcaagccggtccatgtgcctcccgtgcgctcagacgcactgaaaaaaacaaatcccaaacttcccaggaaccgtgggtaaacgtggaaaccagtcctgtgtctctccaggaacatggtagtggctttgaaggaactgtccatccggggtgacttccggaccactgtggagtatctcgttaaccttctggagaccgagagcttccagaacaacgatatcgacacggggtggctggaccacctcatcgctcagcgggtgcaggtaagaggccgctttacctctccaccctccctcccagggcggggtgtgggtgtacgcagagatccgtgcttcccgcgggtactgagacctggagtctttttctaggcagagaagccggacatcatgcttggggtggtgtgtggggccttgaatgtggcagacgcgatgttcagaacctgcatgacggaattcttgcactccctggaaaggtagggcgcacagtcttctccttgctctcctgggatgtggggacagcatggaaggcaggcagaatgaggcttttgctgttgctgttgttcggagatgactctcgatcctcctgcctctgcctcctgagtgctgggatcacacgcatgtgcaccacgctaggtggtgggctttgagggcgggtcagtcgccaccgagctgggactgctctcctgtggcctgcggttcacactgcctgggagagactactggtggatatggggaggcttgcggatctggagggcccgtggggcagggtgaagctggcgaggaggcttctgcttggatcactgttgggcaggactgtcctgcctatgcattgaagggtgacagcggaatttatgtctcctgcctattagaggccatgagaggccattccctgagtgtcccagcaataagaacaaattatcctctctttagaagtgacaaaggaaagacaaaatgtccccacaaaaagcatgaaagacaaagccagtagtggtcacttaacacctatgattggcagcccatgtactagagggtggcaggccacagactggacatctttacctcgtttatttatttatttaagattatttatttatttatttacttattatatgtgactacactgtagctgtcttcagacactccagaagagggagtcagatctcattatgagatggttgtgagccaccatgtggttgctgggatttgaactccggaccttcggaagagcagtcgggtgctcttacccactgagccatctctccagcccctttacctcatttataaatacacatacatatattaatgatttactctgtagaccaagctggcctcgaactcagaaatctgcctgcctctgcctcccaagtgctgggattaaaggcatgcgccaccttgcctggctctattcaggtcatagcacaataccacagagcaggagcttacagttctagaggccgtgacatccagggtcacggcatgggtccattcagtaggtaccagatcctctctgagatctgtgtcccacatttgtaataagattcgactccgcctggtttgctgatgcccaggaagggccaaagccaggtgataggcagcttgtttgatactggggatggagcccagggctttgtacacaggagcacctgttctgccatggagttccaccccagcctcctgagaaccgtggaagatgtcactgagtgagcccaaggcagtgctagagggatctctgctctttcctggactgatggcaggcacggcttttccttcaggggtcaggtcctccctgctgattctctgctgaacattgtggacgttgaattgatttacggcggcatcaagtatgctctcaaggtaattttgagcctgctgggagtttgtttcatttcttctgtgaacctggagtggagcagggtctgagcagtgtgtccctcgggacgcgctgtgtagtccacggtctcgaattcttaacagtcggagtatagaggaggaatcttgagtggaacccaaagaatgctgtcttttatctgaaatcgtttgtgtatgtgtgatgtagtacatgtgtatgttatgaagatacatgcatgagggtaagccttgggctggtattccactgggatggaagtgcggagcctgggccatagcttactgcacatgcctcccttttgggcaaagctctactgcacatgcctccctcctggcagagctctactgcgcatgcctccctcctggcagccctctctgcacacacctctgtcctgggcagagctcactgctcatgcctccctccaatgaagcagctctctagaaagccatagtccatgttcaggtgtctctctctctattcaggtttttatagcaaagtgccatagagcagggtcttataaaaagcagaaggcattactcacagttccagaggctgggacatccaaggtcatggcatggatcaattcaggatcttctgagggcctgtttcctggtctctagtgggtgccttcctttgctgtgtatcttcatgtggtagaggaggcaaggcagctctttggagttcctttaaaaattttaaattgaagccaggcgtgcacgcctttaatcccagcagttgggaggcagaggcaggtggatttctgtgagttcaaaagaccagcctggtctatagagagaggacagctagggcaacacagaaaaactctgtcttgaaaaactggggaaaaattgttttaaattgaatctatttattcatgtgtgtatgcatatgatatgtgtgtgagtgatgtacgtgtgtgtgtctgtatgcatgcatatgtgtgcgtgtatgggaataccacagcatgtgcatgaaggtcaaacttcaggtgttgattcttctcccaccacgtgggtctcagggatcaaactcagcttgtcaggtttgaatcaagcgcctttgcccctgtgtcatctcacaaccccgggatccctattataagactactcgtgacgcacgtacctgaaccagcgatcccatttcctagtaagatctcgtttgaggcttggtttcggtattggaatgttggaggaacatacggtttagtggactaggtccctgatgaagcctccacaagacgccccacccagcgtacaagctgcagtccctgccagccacagtgctacatgggccctgtgtctgcagcctgaagcctttgtccacactcagggcagtagtagactgctagtctgtgcatcaccatcatggggattctgatgtgagcctgtccccacaggtagcccgacagtccctgactatgtttgtcctcatcatgaacggctgccacatcgagatcgatgcccaccggctgaacgatggggggctgctcctgtcctacaatggcagcagttacactacgtacatgaaggaagaggttgacaggtgcgtgagggccgcgctgtcacatggccacatgcatgcgtgctctccctcccacagcatggagcatgcgcagctctctgtgggcgttgaaatacaaagctggcctctgtgtaggcctggggttctagataaagcatgtgctggttcattgtggggcatctggagagggtcccctcctggctggaactccatgcaactggcaagaattagaggggaagggaccccaggcaatgcctttatggttaccagaggatttagagccaaacaggacaatagcaacttggtggctccataatttgtgggctaagtgaggaggtgccagctgccctgggtctgagctgcagggtccacatccctggaggatgggcgtggaacagatgcaggatccagtggctggtcagtgagccaccgtgagcagcgtgctcagctagggatgagggcatgatgtcaccactcctgggcttccagcctagggcaggagatgaggcactgaacaacagcagtgggaggatgctggatgctgcaagctcaaggcatgaagcattgattgcatgatgggtccagctcccattggctgtaccttgctgaagtcacagtggtacttggatgacccaggcagaggaggccacccagaccttcaccaaagagaacaaagtgtgtgtgtgtgtgtgcgcatgcgcgtgcgcaagtgcctgttagagctcacttctggaagctaggtcagcaaggggtacctctttcttaatccccagtattttagaggaagataggttagcatacttacaccgtcttgtaaccatgttccaactactaagaatattcaagatttctcctaggctctctgcccaaaggccggcttccccagtttaattaaaggaaggatttggaatcagttaagagttattgaatagttttgattgatttcttgatggattaatttccctgtggcagggctttggggggggggtggattacatcagtaatagaaactgattttcagctagaagaaataaaggccctaatgtctcacagagggtgacggaatgcctgccttgggaaggggagattccccaaaagtctggcgcccttgctgggcctcatccatctcccacatgcccccatccccacccccgtagttaccggatcactatcggcaataagacttgcgtgtttgaaaaggaaaacgaccccactgtcctgagatccccctcggctgggaagctgatgcagtatacggtggaggacggagaccacgtggaagctgggagcagctacgcggagatggaggtaagcagcacagagcctgctctggagctatgggtctgaaaccccattcctcagccaacgggtccctcagccagtgagccttggtgcactcttcggcatgcagggttcagcccaattccttgtgatattcaaagggtactgtttaaaggagctcatctcctgggaaggagcaagaattgcttagtgccaagtggtggtgtcacatacttagtccaagcactcaagaggcagaggcaggaagatctctgagttctgggccagcctggtctacggagtgagctctagaacagccaggaatacacagagaaatctcgtctcaaacaaaacaaaacaaaacaaaacaaaaaaactgcttagccatgataacagtagtgattaaaaccacaggccatcacggactgagcactgaccatccagtgaccactgacctaagctcattaaatatatgtgcatactcacatatatgtgtgcatatatacatctatacgcatgtatacatatatatgtgtatatataaaaataaaatatatgtatatatatgtatgtgtgtgtgtgtgtatatatatatatacatatatgtgtgtgtgtatatatatataaaactgtgctaaggacggacccaaagacccaaaacatgtcagacaagtgttatagcaccccaaccctgttgtttataatgttagcaagttcctgaggccagcacacatgtgattcctgttgtatgcatgaagacatcagacccaggaggatgagctgagggtcttgcttgcgagtacccagagccaagctccaagcctggggctggctctccgctgtaataagcgaatggctgctatagagaatgccttcctgtgcaggccgggtttttcacctcaggtatgtgagggagaggactagccaccaatttacagaggggacactaaggctcatagacaaaggcagcttttggaattcgcagagaggatagatggggttcttgggcacagggacagctgaacatggagtagcctggtcctgtggatccacgcccacaatctcatgtcttaagcatcttcagattcctggtcaggcaaatgagttgcaggatagacttcaggcaggtgcttcattttccaaagcactccctggagccctccctcaaccatgggcatgggattaaatgtctgctttatacagctgggggtggagagggcagcagagggcagtgggttgttcagcagtgggatattgtcttagggttttactgctgtgagcagacaccatgaccaaggcaactcttatgaggacaacatttaattagagctcgcttactggttcagaggtctattatcatcaaggtggaaacagggcagcatccaggcagtcatggtgcaggaggagctgagagttctacatcttcatctgaaggctgctagaagactgacttccaggcagctaggatgagggtcttatagccacccacacacacctactccaacaaggccacacctcctccaacacggccacacccactccaatgaagccatgcccactctaacaaggccacacccctccaataaggccacacccactttaacatggccccacctcccaacagtgccactccctgggccaagaatatagaaaccatcacagacttattctgagaagtaggtcccaaatatgtcctttgtcgtgtggacattgtatagcatatttgcacagacctggaagatgtcagtcacttgaggtgttgcggtgagctccaagcatgggatatgagagtctgctgccgacagtgtctcagcgttaagtgtgtgccacactttaccagatgggtggtgccgcaacccattcacaccggcatcgctgccccaaacacgcgacacctcaggcgtggctatggtgtcattaggttatcaattgccgggtcagcatcctttgagtcacagcatcctttgagtcacgtggcaaggccaccatcagtgcaatctattacactgtgactgactttatactaactgctatgagtaataggatttaactgtgtttctgagattgagggcttcctttgaaaataggaggggtctgtagctgcagctaagcggtagtttgtctctctggcatgcatgagactctaggttcctccaccagcctcagcttcacaaatcgaaaagggaaaagcggtctctgtgtctgtgaaatgggtggcacacacacctgcctccctggctggccttgtagacggagcccatttcaggatggtgcccttgcctggtgcacagcgggctgggacaaatgacaggttccttgtcttgtacatgaatggcgcccagagatttgctgtcactgtgatgcaaccccagctccacagcctttcgatgtctctgggtgccagcccggggaaccctgacctgtcctctctgccacacaggtgatgaagatgatcatgaccctgaacgtgcaggagagcggccgggtgaagtacatcaagcggccaggggttatactggaggctggctgcgtggtggcgaggctagaactcgatgacccttcaaaagtgcacgcggtatgtggctcggggtcctagctactttggctggcccagcaggtcccaccatgtcatcctgttctgagagagcagaccattgtctctcaattcctgtccagtccgcatcattcacagacatgctctgctcaggcgatgatgtaacatggcagccatggcacttgtttgctccgttcgcttcccagattttaatcttgcttggagcaaagaccaagatcccagcagaggcccctcctctatgatggctgtggttttccctctatctcttccctcctgcctggagcctgttccctctggctggaaggacctgcctcaggcatggcctgcgcactttcgaggtgacaggtgatatgatttctcaccccacccatgacccatgaaactaccatttgctttctctcagtgctggggataaatcccaggtcccgatcatggtcggcaagcactccagcattgagctccacctggcccttgggtttaacattttgttaactgttacggttgttgttgttgttgtaggtggtagtggtgttatgattgtgtgtgtgtcatggttgaaggataactttggggagttggttctctcctactatgggttcagacttatatataaaatatgtccatatgtatatgtaatgtgtagggataatcatgtcaggttctgtgagcgatctggggccacctttgaaagattattttcttcaattagtatgtgctatataaaccagattgtatctttcatgcagctttagattcgcaggattagagatcctatgacgggttctcatgttccatgcaccccatttccctattatgaatctaacaatatttaattgctattaatgtaattattgtgattatatgatccatttgtcacaatgaaacctccattgatgtgttattaacataatactctactcagatttccatagtttttaagatggtgattaaatacacataacttagtatcttcacccccccctctctttgtgtgtgtatgtattatgtgtatgatatgtgtgtgtgtatgtgtgtgtgcccatctatgtctacatgctagggattagaacccagggcttttttgtttgctttttttttgtttttgttttttgtgagacagggtttctctgtgctgggattaaaggcgtgtgctaccacgcctggtttttttttttttttttttttttggcttgttcttttgagacagggtttctctgtatagccctggctgtcctggaatggaactcactttgtagaccaggctggcctcgaactcagaaatccacctgcctctgcctcctgagtgctgggattaaaggcgtgcgccaccactgcctggctagaactcagggtttcatgcgtattggttgtcatcccctgcgctcccctgttacagccttgccttctccattttgaacattccaggtgttaaacttgtgtggttgagcaaacaccaccactgctcagacccttctttttataaaaccaaaacccataccctggcaaccactccatctgcatcttcccctagggatccatctattctgggctcctccaatgacaggagtcaggcatctctagccagtttgtcactggctgacttcactttgtgtagagctcagcgctagagcgtgtgcattgcatgttcaaggcccaggcctggagaggtgactgtgattaagggcagttgctgctctcgtagaggacccagattttgattcctggctcccatgccaggcagacacaaccggtgcccctggcctccacaggcacctcacgcatgggaacataccccgctttcgatacacacaactaaaatcttcaacccaaaataaatttaaacatttaaatcacattagtgaagccaggcatggtggtgcaggcctgcagtcttagtactccagactgaagcatgagggatgtgaattcgaggctagcctctgctgtgttgtgagaccgaaaaacagccagaacctacaaagtaaaccaagaagaaaatagggaaatagttattatcaaaaagaaatttagaacaaaaccagaactaattccctctaaaactggagtataagtcacctgttttgtgtcatttgcaaaggagataatttgaaaaccctgggtccaggctagaacttagcaatgtagggttcccgggatgttgttgtctcttgcttacgtctcaggtttcaagtgagtaggtcggtggtttgtcgggtcagtgctttctcctggtctatctgtgacccgtcatcacatctcataggcttgctcatctgtgacccatcctcgtgtctcacgcacaggctccctggtctgtctgtcaccgtcctcctgtctcacaggctccctggtctgtccgtgatccttcctcctgtctcacaggcccagccgtttactggggagctccctgcccagcagactctgcccatcctcggggagaagctacaccaagtgttccacggcgtcttggaaaatctgaccaatgtcatgagtggctactgcctgcccgagcccttcttcagcatgaaggtaagggcctgcgggacccaggtgtacacagggccctgtgtggggcgccattgtcacagaaaggcgtcttaccagctgaggtgctttgggtgactcaaattgacctctctgtctccatttcaatctcgagtggggagagtggtcattctacctgcttgctgcggctgtctctaaaaaaaacaaaagaaaagcagctgaagagggccgagctggctcagtgaccccagtgctgagagcacccgtgtttggtgggatgccagcacccatgtggggcagctccccggagccaatacccttttctggcctcggagggcaccagtgttcatgtgcacagcccacatgcagacacagacacatgcattaaatttaaaaataataaaaataaactataaaggaaaatggcgccaggcctttaatcccagcacttgggaggcagaggcaggtagatttctgagttcaaggccagcctggtctacagagtgagttccaggacagccagggctacacaaagaaaccctggctcgaaaaagaaaatggtcaagaaagatgtttggattttacttggcgctaagcaagtgaccaacagcataagcttgtcatgtgatcttatctacccccccttccccccccccacacccatgctggctttctagttacccagagagggtacagactctccctgagtggggagactggggcaaccctactctaggttacctcaaaggctgctgggcccagatctccatgagtcacgagtggctactgtctgccgggaggctttctccatccttgagtgggtctagtcgggtgagtgtccacggcagactgggatgcccatgcgaatattggtactcattgcagacggggacgcccatgcgaactgtggtgtccgtggcaggcagggatgctcacgtgaacggtggtgcccacagcagacggggacacacacatgaacagtgctgctcacgcatataagaggtggctgacatggttgtctctctgcagctgaaggactgggtccagaagctcatgatgacgctccggcatccctccctacctctgctggagctacaggagatcatgaccagtgtggccggccgcatccccgccccggtggagaaggcagtccgcagggtgatggcccagtacgccagtaacatcacctccgtgctatgccagttccccagccagcaggtgcgttcccccggcgagccacacctacgcccattcctgtgtcaggcctctcctaagctgggctagcaccgagtgtcgtgggcctgcggtttctctttaacctttcctgtagaactcctgtattttctcccaagggctaggcttttgaggcgcaccccagtccccaggtctcgcaccagccactcaggctcacggggaggtctcgggtgcaaatagagctaactctttcccgcccagctggctcaagtcattagctgtggaaccttgtccctgggtcaccggttttgaagccccgtagctgtgagcttcatgcatcttaggactggaaaccattagtgtatatatcccattagtatacaaactaatacgtttcctggcccatatagtttatttcctctgttgggcattccaaagtcatttcccatacacctctactgttgccacctcctcacccacacacctccgccaccagagaggctaagtcaggccgttcctagcggtcaaccattctaaaggcggaaactgtttgttctgttttttgcagtgctgggcctcaggcacgctaggcaagcactctaccactgagctacatcccgagctcctgaaggttggaatattgctcagccatatagaggaacgaagttctgattcatgctcccccacaaatgatgagccttatgctaagggcaagagctgctcataggaaatgtccggaacaggcgatcagtgtagaaaggaagtctattagtggctgccaggggaggggtggggggaggcgaggactggctccccactctccagatataccacagctggagcaggaaggcagttgtaccccaaccggaattgatgaggccccaccgagagagggattcgcttggaacttttctggaatttctcaaattttagttttctttaaaaatcctttttttttttttttttttttttttttggtgggaggtgagatggctcagcaagtagagatgcttggcaaggaagtacagtggcctgagttggacccttaccctcagaacccatgtaagggtagaaccgattccaggaagttatcctctgacctccacatgtacagtggtgcatatatcctcatcctcatatatactacacacacacacacacacacacacacacacacacacacacacacacacacgtgtgcacatatgcatgtgcacgcacacacacactaatttaaaaaaggcatgccaatcgcacgaactctgacccttcccctcctacgctcacacggttgctggacactccgtcttcttcttagtcctgtctggagcgtggatcgaacatcaatacagtttgaccacatctttgtgagattgttgtcattctgggcccctgggtccccaggaagacattgaaagggtgaccagggctgttacacagaggccaggtggcttgggtttttgagtgcaaccagtctgggacctccctgggagcccatggtgggtcccctcataatactgccccgtagcgactggatcatgtggctggcagtagcccgacctgttttgtgttctcatccagatagccaccatcctggactgccatgccgccaccctgcagcgtaaggcggaccgagaggtcttcttcatgaacacacagagcatcgtgcagctggtccagaggcaagtgcatcccaggccctctggaggcctgagtagcctgtaggaagccctgacttcaacccccagctcagggcgcaggaggcagaaagagagcccatcccccatgtttggaaatattatagaagagagaaaaaaatgttgagggaggacacacagcacttttcaaacagaagggaaatctgcagaaagtatttcgcaaatgtcttcaagtttgacttttgaaaacagttttgtgtgtttggaagtttttgttttgtggctaaaatctgctaaaaatcctcctcttcctccctcctccccttgcactattgcttgcaaccagggcttcgtacatgccacggaagtgctctaccaccgagctacatcccagcccttggtttctctgaggaagggtcaggccaccctccaactcatagtccttacaggaagagtgctcttgcaagcatggaccatcatgcctgtggttccttccccttcttaaagtcataacgccgaactgagacagtcaggtgttcaggtgaagataaggcatggcgacagggctgcttttggttcctcagataccgcagcgggacccgtggctacatgaaggctgtggtgctggacctcctgaggaaatatctaaacgtggagcaccattttcagcaaggcaagagatgccaccccacccccactggtgtcaaccacaagctctgggcggggcgagggggaggtgccacaagctctgggcggggcaatgggggagttgccacaagttatgggcagagcaagcaagcagggaggtgccacatgttatgggcagggcaagcagggaggtaggtgtcctgaactcactcttctgggtctcctgtgtccccacagcccactatgacaagtgtgtgatcaacctgagggagcagttcaagccggacatgacccaggtgctggactgcatcttctcacactcccaggtggccaagaagaaccagctggtgaccatgctgatagtaagatggggccccaaaccctggggtgggggcggtcaggggctgggtcttccctcctcctcgctcctctttcccttcctcttccttccttcttcccatcctctccccacactcttcagttctgtcatggaaccaaggtgcgacacatgtcaggcaagttctctgtcacgaagccacatccccagccctagtccccaactattttctagaaaggtccagaaaataaagacatagaccttgcacgcgttttggtctccaacctaactgctaaactctgtcattgtttatggtgtggctgcacaataaaactttatttgttataataggcagtgtcacaaagcacctggctctgtgccagaactttcttggttgcttttaaaaatcttaattagttttcaagattacatattaaattcatttattattgatgttgttattactagtatcatcattaattctgacgttagggctccctatgtagcataggctagtctcgaactcctcgtcaaaagaaaacctacttagattcccaaggagttgggacaatagaagtgtactgatagacacattcgtgctaacttctctccaacgcagactactccatacctagtgcagtttggtacccaggaagctggattagtgacatccttggcaaaggccactttagaaggaaagggttagctttggctcttgctttaagggtacagcccagcatagcgagaggccatggcagcaggtgcgcatggcagcttgtcacgtggcatccacagtcaggaagcagacacaaatgaatggcattgctcagttctctttcccctttgcatttggtccagggccccagcctagggaatggtgctgccacactcagtgcggggctccccgactcagttaacctaatctggagatgacctcacagacaggccctgtgctctgtctcctagtcaattctagatcttgccaagatggcaatcatgattcccttaggtgtcactgatgctcccagtaggggctttccaatgagctgtggccctggaatggacttccttcctcatcttatttctcaaggtcttttatctgtcacagagcattagcaacaatgaaaatagaatacagtgccattaaccgaattgtgcaagatcagctgcttccaggacgtgaacaggaaaggaaaaataatattgtgagcttttgtatgtgagggtgccaacctggtgttctaatgcacacatgtgcattgcacacttgaatgcaggtgtccaaagagccagaaggaaggcatcagaccccctggggttggaatgacaggtggttgtaagctcactgataacttaggaacctaactcaggtcctctgcaagaacattaaatgttctttatggctgagccatctctccagccccttactgagtaccctttgaatggtggccctcttagcctagctgctggacagccctgggctctgtgtgctccttacagccacagggctgggacagtgagagcaatgctgtagctgtctgattctattgtgagggagaaggtaacagcccattaaataggaaagcagcaagggcttttacgattgggacagcacatttgcataggtgtgaggtgactcagcctccactctatacgtggcagggtgtcttagaggacagctcgggctgatctgggtggtggatcacagtggctcagcagcccccacatcctcctgtcacagatctgtctccagtggatgtttagggagtcccttctctgagctgtccccaggcccctcttacagcgaagacactagaggaaacacagggaccctgtgcacacggccccatctgcagcagaatagctcctcctcgctcagcagaggggactcagaccagggccaggagatggctcagaggacagagcacctgttgcacacgtgcgaggaccagagtttggatctccaaagtccacgtaaaaagccgctggggatggtggcccacttgtgatctcagaactccagagatggaggagataagggacccccaaggccagcagcctagaccagccagatccgtgagttccttagtccagattcaggagagaccctggctcagaaaacaaagtggggcacagtggagaaagacttctggggtgggctggtcccgttcccacacgcatgtgtatacacatgcatgctcattcacacacacgtgctccccagcacagcccctcgggcgtgagggcatatgtggtgtgcataagtcagtgaatgaatgaaatgaacctacagtaaaaagaggcaagggctcccccccaacccccgccgcccctgccccaaagacagggtttctctgtgtagtccaggctggccactggcctctccttcctgagattaaaggtgtgagccaccattgcccaggtaaaggcgttaaaaacaaaacaaaaaaccccaaaaaactggctagatgtgtttagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagaaatgtactcatacacataaataaataattctttttaaaaagagagagtgagtgagttgaggctagattctctccctccctcacccctttaccaaccctcccatccctccccacccaatcctccccccatcccctgctccaacccccctccacacacacacgcgcgcacacgcacacacacacacacacacacacacacacacacacaccagtcaagtgctggcccctcgggcagagcaaagtcaactttggttctgttgctgcccctgaaggatgagctgtgcggcccagaccccaccctgtcagacgagctgacctccatcctctgtgagctcacgcagctgagcagaagcgagcactgcaaggttgccctcagagccagacaggttggtcggggagcacggggagcacgggggccggtgtctgtggctctccctcctcccagctcccgtcatccctgtcctctctcctcctgttggcaggtcctgatcgcctcccacctcccctcctacgagctgcggcacaaccaggtggagtccatcttcctgtccgccatcgacatgtacggccaccagttctgcccagaaaatctcaaggtgagcctcagggacagaccgtgggtttttcttaccctcaaggagccccccagttttagtgacatccagttcagagtggctaggatggacggtcccagggaacatcagcaggctctgggagttgtaggtatggaaatctgtttgcacagggcagcaggattgagtctttcctggccaatacagggttaacatctttctttctttctttctttctttctttctttctttctttctttctttctttctttctttctttctttcctccttccttccttccttccttccttccttcctttcttccttcctttcttccttccttcctttccttttttcttttttttctggagcatagcaggaggtgggagccctttgcagtgggagtgggggatctggggtgggggagttgggatagttgtggggggactagggtagggacagggaactgggatagaggtgggggctggcactgactttatctttctgggctcctgcccgggccctagcttatcataaacttccaggcacccatcagtgtttgaaactgggaccctgccctgggcacagtcaccccgcactccttcattgttcgctctcccaaggctctatgggacactgcaacagtgaccgtgacttgtgcctgcgcctcaccccaccccaccctccagcttctggggcacgcctactcatgttctttttgctttgtggcccctcatgtttcccatagaaactaatactttcagaaacgaccatattcgacgtcctgcccactttcttctatcacgagaacaaggttgtctgtatggcgtccctggaggtaaggagaaactgggacacacactccgagaccctatgttgtgcgccttgcaaatgtgaccttttctctctaaggaaggggtttctgttctctcacaggggctaagttgagctcagagatgtgaggtgattttctcagggccacacagacagggacagagccaggattcacacttcattgattttcttgcaaagtccacaccagtaacactgccagggtacagctgggccacaccccagtgctaagccagatgcaccctgtccaaacttcttatccatgagcattcagtatcttaaaggcttttctgtctggagcggaggacacagccacctcccttgtacagggagaggcttgcctggcagggtgtctgacaggcactctgtcccaatagattcctctcaggattgcagtttgcctctgctcctgcaatgaggaactgacgtctcctgttcaggaacttccttgccccagactgagttaagtcactaacagtcttgtctcaccctggacctccaagctcagtgtctccactcccctgccttgtcctgcatcttttagactctgtgggtcacccatgccatgccagctttgcctaggtcttcacagagactggtttggccttttgagactgtgtcagctgcaggggccctcactttcgagatccagcacacaccccatcagacgttattttgacaagggttatttcccagttgtatctgtgagggttttattttggcttttaaaaaggttttttttttttcccccctctgagacagagttttctctgtgtaatcctggctgtcctggaactcactctgtagaccaggctggcctcaaactcagaaatccatctgcctctgcctcccaagtaatgggattaaaggcgtgtgccaccactgcctggctctcattccctcccccccccccccatggcagcttccatgctataatggcagaatctaggggcttcctcaggaatgaggtctgccaaagtctgaaatgtttgctcctaggctcttgagaacccccctttcgtgtaacttagagagcctgcagctgccctgtgcacagagcttcgccctggtctctgtgaaggttcagcgtcctccctctgcttcctcaggtttacgtgcggagaggctacatcgcctacgagctaaacagcctgcagcaccgggagctcccagatggcacctgtgtggtggagttccagttcatgctgccctcttcccaccccaaccggtagggactggttttccttgtttctttcctctctgtctcgtcttcgggaggatccagcaagtatgcgtggctgctgggcagaccccttcccagccataggtctcctgcagtcttgcgtgctcatctgtggaacgaggacagccacccagtgtcatctcctgtcagggacccacaagtgctgccttgaatgcccatcagtggacgtgaagtgacaacctaattagttagtcacaaggtagtgttcaaatgtgggccagtgagatggagcagagggcaagggcactggcctgcaagcccaaagccctgagctcactccttgagactcacatgatagaaggagaaaatggactcttggaagttgtcctctgacctccacatgtgcacacacacacacacacacacacgcacatgcacacacacgcatacactcacgtactcacacactcacgcacacacacttataaaaacaaaatgttaaagtgctgagtcgtcatgtgtgggtcttggctgcatattatacagggctctacaacattctatcactgcagtggactgtgttgtcccagaccactggggaaagtaaatgagctaagaccacaccccaggacagtgcctggcacaggtgaagctgtggtagcagtctcggggcggttttggtttgcactcttacaaacagaattgctgtcctgtaacactagtggggggtgggggtggggagtgtgagaagcctctatgtgtaaagtatcttttattctcctgatgtaattgttgtctccgaggtttactgcctctgtctgttaacctaggctgagtgctggttcttccggcctctgtacaatcttgtctaggcctaggatgtttaggcctaggatgttttcagcctctgagacttacatctgaatcagctcgcccttgctagctctttctgagctctggctggctgatccactcagctgttctagctcaaactcctctccaagctgattcagtctggcttctcgtggcctctccagagttgccctgcttggcctcaaattaactttggcaaagatttgttctaatcttctggctccttctcattctctggctcaccctgtctccagcctgcctctgaaaaactctcccattcaaatggcctcctctctctgcactgctcttataagtagcctctctttcctctcttctttggtgagagttgggcatatcctgttctgtcaaatctttctctgattcgtcactttgtctgccactcaattagacatcgtttcaaacacggctgctttcttctacaaacttattttaccttcattgtttgggattaaagttgtgtactaaggctgaaccataccacaatcagaaacaggtttttccagttaacagcacaatctcggggttcacagtgtgatcaaataccctgcagcatctgtgctcttggtcccctcagcccttccatcagctgaccagaagtggccttcatctcagttttgaagaaaagagtccctggatcccctctctcccacaggctgagcataggagccagggcctgaatcatagtctcactgagagctctgttgctggcgcctgcggctgctgggaaccagaagcaggaccaagggtgtggcttgtctgtgtcctctgggagtgttctcatggggacgtctgtctgaccgcacactgctcatagtctctttaacccctcttatttcagaagcccagtagagtatggaaccttctagaatgtagttatatctccccaccgagatccaaaggttccctccctgccactatccctggtacctctgtcttggagtctctgtgggtttctcagaggccttgcttgtggctagagtggaggtcatgtaacttgggttccaagagtcagaactcatatatatgaggcagggtccgtgttttcctgagcaggttttcctggttctcttgtgcttttgttttatttattatctttgtgcgtgaatgtatatgtgtatgtatgtgttgtatgagatgtgtgtgcatgtgtgtgtgatgtgaatgtgtgtgagaggggtatgatgtatgtgttcatgtgtatttgcatgtatgtgtacatgcatgtgtgatgtgtgtgtgcgtgagggagatatgcatatgtgtgacacgtgtgccggcatgtgtgtataagaaaggtgtgcaggtgtgtgtgtaagagagatgtgtgtgcaggtgtgtgtgtaagaaagatgaatatgcaggtgggtgtatgatgtatgcataggtgtgtgtgagagagagacatgtgcaggtatatatgtgtgtgtgagagagacatgtgtggaagtacatgtgtgatgtgtgttacatgtatgcaggtgtgagatgagtgtgcagatgtgtttgagagacacatatagaatgtgtgtgtgagaggtgtgtgcaggtatatgtgtatggtgtgtgacgtgtgtatgcaggtatgagtgtgtaagagagtgtaggtatgtgtgtagatgtgtgcaagagatgtgtgccaggtgtgcatgtgtgagatgtgtgtgtaagtatgtgtgtgagataggtgcaggtttgtgtgtgtgattgaaagaaaggtgtgtggaggtcagaggacaagtccctggggcctgctcttttctttcacccttatgtgggttctgggaatggaactcacatcatcaggcctgtgaggcaagagcccttccacccttccacagcccctccctcaggactttacaggtgtttctcttcctgttgcttttgaaagagcacgccttatagatgagaaggaaggcccccaggaggcggctccagcgccccgttttttgtttttatctgtttgcttttttaacctttcttattttttcttttttaaaggcctgcagttctttttgccccattatgagacaggtcttgtattgattcagcttttttaaggatggtagtctgtgagcatgggtgtgtgcatgtatgtatgtgtatgtgcagtcagtacctgtggggggtgtgtgtgtgtgtgtgtgtgtgtgtgtgtaatgcagcattttgaaattgtcccacaggagttgttttctctctgactgttttgtctgagcaggaccgtgacttccctaagggacatgggggtcacgtactatttcaggggggacctacatacatgcccaggccttcccagacacacccagaaatgcacttcaccattctgcagggtgattctaactccagtaaaattagaaaggaagatcaatcattaccatgagtttgtgaggtatctgagcttggttggcacatgggcttcttattggcttttgcccagataggctctaacctgggtctggtaaggcggaaatagcagcgctcaggagacaagcagcgtttaaggccaggcagaccaacacacaagaccctgggttggttggtttgttcattttgaagaagaaaattccccggctcccaggaaaggatagaggtagaggcttggaatccactataccgttggctacagcagcacaggcccagcaaagccacattcatttaggcaaaggggacctttcccaagtccccatacaccagccatgggccaccctcacaacagccctccttcctaggaagggcggggtggttccagcttctatgaacattctgtttttacacttaatggattcatccctcccatacctgattccagagtcctcacatgcctgttttggttcctgggaacagtggctctctaaacccttaacagccactgacttcatcccaagacaggggaaaggatgaggggattggaggcctggggcaatcctggaccaaacttgcctcctccccagctgcctgaagatgggatctccaggggaaactgaggctgggagcgtacctcttctgtgtgtctacgtttgcctctctggatttccctcgggactgtggctggactgaacttgtttatatgtgtgcatcactcattcatgtgactaaactcgcttatgcggtcatcattcactcattcactcactcactcacttcctgtgtcctgaggagtctgatgcgaccccctcagcacctgcccagcaacctcaagtcctccctcgtagcccccatttcagaccctacctatctacggaagcatcttatcctgatctggctttccaaagcatccgtcccaggaagagctttgagggccgagttggcaacaactgccccagtctccctttctcctcagcctccctctctcctcagcctccctctctcctcaccctgcaggatggccgtgcccatcagtgtctccaaccccgacctgctgaggcacagcacagaactcttcatggacagtggcttctccccactgtgccagcggatgggggccatggtggccttcaggagatttgaagaattcaccaggtagggtgtaggggctgtatgggcttctccagccccagccactcattcattaacacttgggcttggggagacccagattcgggcaccgcagttaagaattacagactcgggctggagagatggcccagcggttaagagcactgactgctcttctggaggtcctgagttcaactcccagcaaccacatggtggctcatgaccatctgtaatgggatctgatgccctcttctggtgtgactgaagatagctacagtgtacttatataaataaatcttaaaaaaaaaaaattacagactcctcggggagtaataggaaaggctggcccatgggacttggctagacaggagcccaaagttctagcatgctgttctaccacagggactggcctcatcctttagaggcaggggtccctcaactttcttctgtcctaccccacaggaactttgatgaagtcatctcctgctttgccaacgtgcagacagacactcttctcttcagtaaggcgtgcacttccctgtactcagaggaagacagcaaggtaagcccaatggacagtgttggggggcgtggcaggctctagccccgccctcttgcctcagcccctgtttctctcttgcagagcctccgagaggaacccatccacatcctgaatgtggccatccagtgtgccgaccacatggaggacgaggcgctggtgccagtcttccgtgcctttgtacagtccaaggtattcccctcgtgcctctggggtacctcggaggacaggctgtcttgacctttgtgttgttgctgtcacaaaatacctcaggctgggaataaagtcaaaggttgatggggagggcaggagagatggctcagtgggtaaggggctctcactgctcttgcagaggattcaggttcaattcccagcacccatgtggcagctggcaaccatccacaacactgtggtacacagatatacataggagcatgacactcataaacatacaataaatcaagcgcagatatagctagatgggttttgtcttagggttttactgctgtgaacagacaccatgaccaaggcaactcttttttttttttttttttaaggcaaactaggacacctatcaactggcagccaagcctttttttttttaatatatagatttattattatatctaagtacattgtagctgtcttcagatgcaccagaagagggcatcagatctcattatggatggttgtgaaccaccacgtggctgctgggatttgaactcaggaccttcaaaagagcagttggtgctcttaactactgagccatctctccagcccccaaggcaactcttataaagacaacatttaattgggactggcttacagggtcagaggttcagtccattattaaggtaggaagcatggcagcatccaggcaggcatggtgcaggaggagctgagagttctatatcttcatctgaaggctgctagcagaagactggcttcaaggcagctaggatgagggtcttaaagcccgaacccacagtgacacacctcctccaacaaggccacacctactccagcagggccccttttcctaatagtgcccctcacttggtgtagcatatgcaaaccatgacaggtttttaccctgctaattaaagttcagaccaaaagtggacactcctggtcacccccacaagacagtgtggctgtgtcctgactcagttcaatctgctcttgtgttttctgtccatagcattggagtctgaacccttacacatatgcctcataacttccagtgcacacagcatcagtatataacacggccattgaattcagactgaggatatagctcagtggtagcgctcttgcctggcatactatgggctctaggttcaaatcccgttactaccaaaaaaaaaaaaatcacaaaatgtacaacttgatgcttttcaactatgcacactgtcagtttgagaacatcacctgagaagcagaaccccgagctctctcaaccttctccccagcccagcagaggcagccaccgacctacttcccggctctgtagactcgctcatcctgaatgttggctgctaggggagcctttgactggcttcctgcagttagtgtgcttgtggagttcatccatgtagcagcatacgtcagcacaccaggcccttaccaaccaaataatcttccgccgtatctgtgcttttcaacgcagaagcacatccttgtggattacggactccgaagaatcacattccttgttgcccaagaggttagtcccagtccttagtccatcgtcttccctgttctctgagcctcaggccgggtacttaataattattctcaagggtaagttagaagcaattgggaccatgtttccagatgattccttgtggaagcagactgagccatttttaacgattacaaaattagcaggggcagggctcggagtctactttcactgaattgtcttttgcatggatttcttttggcagagagaattccccaagttcttcacgttcagagcgagggatgaggtaagagcgaaggtgttgatattattatttctgagtatccttcatgtgcccccatgggcatgctcagagcctaaagtatgggccctcacttttccctggaatcatgccgccacaaggatcctcatgtatcctttagcgagcttgggcacacagggctcctgctcacttgatgtattttgcgtttgctgctgtactcagtaagctggctgcctgctttataagtaaatctctattggtacacagatacagccgttggatttgctgtcatgattttcacagtcactgagcctgtatggctcatcaccctaaaacttttttgctgactcccgttctagagcaggtggccttatgagctcagcgctttgtattttgatggttctgggtctgttttactcgagtaaacaacatccttatttgggggtagcggacatagggacttgttatttttctcttcagttcagtttccaaaactgccagttgattcctttgagaaactttcttccataaagaagccaggttcagaagttgaagaataagagacgctgacagacagcagcctcatggctctggcatgtcctggggcaagcagggcatcctcaggagttgctttcgcaatgcccatgacctgcaaaccccttgagcctcagagattgctagtgacgaggtaccccaataagggctcgtttctgagcaccaggctcagcaacatgcagcctgggtcatgcaggcatgctgctgtcacagtgacaaatggactgtcctctctctggctggcctacagtttgcagaagaccggatttatcgccacttggagcctgccctggccttccagctggagctgagccggatgcgcaactttgacctgaccgctgtgccctgtgccaaccacaagatgcatctttacctgggagccgctaaggtgaaggaagggttggaggtgaccgaccacaggttctttatccgagccattatccggcactcagacctgatcaccaaggtaaggtgacacagggtggctccctgtccccaccatagtgcttgtccttctgctctggccttctcttttcaaattcccatctgggctgcattctggggatcaggaggtatcctgactccttgcagacacatcagctagcggtacttcagtcagattcttattttctgacattttctgggtagaagagagtgctaaagggatagaaagatgctggcttgttcagggaatttcttgtattttctgatcaatgactggtaacgatcacattgtgaaaattcaaatgttattacaaagtcaagctgagggtgggacggcgtgggtcaggagatgaagcactcaccgttgtgcaagccagaggagttgggcccagagcccacatgaaaactactcaggtatgggttccctgtgatcccagcagagacagggaatccccaggacaaggaggctcaccagagtgagcaagcttcaggtctggtgagacaccctgtgcccagaaagagtggaaggctgggggcacggcccacagctgcttgtaactccagctgcatgggatctgtcacccggggactccatggtcactgcatgcactcacacatacgccccccccatacacacaattttaaaaataaaaaaaataaaaggaagcagagagcaattcatagaggataccatcaacttagctacccaggtactgttttggtgtttgtttgtccttagcacctgtgtggcccttgggcacataggccacactccctcttcccatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacggcccacagctgcttgtaactccagctgcatgggatctgtcacccggggactccatggtcactgcatgcactcacacatacgcccccccccatacacacaatttaaaaattaaaaaaataaaaggaagcagagagcaattcatagaggataccatcaactttaggccttaacacacaagtgctcacatgttccttagcactggtgtgcacacatggacacatagcacacacatacatcatacaaatataataccacacatacatatgcttttaaaaaaatcacgtgagagtgccaagccagatgtggtggcgcacgtctttattcccagcactcaggaggcagaggcaggcagatctccgagttcgaggccagcctggtcttcagagtgagttgatgatctttctagaaccagagtcccaggacagccagggctgcacagagaaaccctgtctcaaaaaacaaacaaacaaaaaaaagagaccaagagtccttcagtggagggtcaggcctactgatgatccttctggagctgagtccatccctgtatggaatggaaggtcagggccagtgtaggcaggacactcagacaattgtggttttacttgtgggcaatgctctatgtgaacaaagacccattcatgaggcatcccatttagttacgtgcccatggacatactgggtatgttggggatgggaggagggctgattttaaaaagatcaaattggctactgatgaatttaaaaactacaaaattacatgtatgtattatgtatgtatgtatcgggggtatatgcatgtaccgagggtgagaggaaccaccatagcacatgtgtgggtgcaggaggacaattgtgggggtctattctctcctactgtgtgggatctggagactgaactcgggccgtcaggcttggcagcaagccccactactcccaagcataccctgatgccacagtgtagatgtctgaggagcagggtgcagaacacggctcacagcctcaacagctttctgcccacagcaatgctctgccatctcaccagacacgccaggaagagggggagcatgagctaggtacaaggccaccggctgaggctagcctccttgctctccctttggcaggaagcctccttcgagtacctgcagaacgaaggtgagcggctgctgctggaagccatggacgagctggaggtggcgttcaacaacaccagtgtgcgcactgactgcaaccacatcttcctcaactttgtgcccacagtcatcatggacccgctcaaggttgtaccgctgcggctttcctgggccccgggtgtgttttcccactgttcttcatgccacatcgctctggggtcaagtctcccggtcctccaggcccaagttctaggattgtctcaaccagggtttgactgcttcaaacagacatcatgaccaaggcaactcttataaggacaacatttaagtggggctggcttacagggtcagaggttcagttcattatcatcaaagcgggagcatggcagcatccaggcaggcatggtgcaggaggagctgagagttctacatcttcatctgaaggcagctagcggaagcctggcttccaggcagctaggatgagggtcttaaaacccacacctactccaacaggaccacacctcctacaacaaggccacatctcctccaacaggccacacccactccaacaaggccacacctcctcccacagggccacaccctcttatagtgccattcccgggctgagcacatacaaaccatcaccaggatgaacacatgtggttagctgagagtcaggggagaacagacccgctagaatgtccagatgtttgggctcagacaacacgtgtgtctagaatgtcaggcagagcttattccctctctaactctaggatctgctgttgtaggagagagcctaaggtctgaggcaggggcactgtgcacaggccaatacttcaggagacagacctttaattattggtgattctagaaccagagaagatgtcagtatctgtaggagtcacaggacccacatggatgccctggcctgactggtccacgcagtccagaagaaaactgtgatggcctgggaggtagagagagatagggtgactcgtcaccccatcactgaggatatagctcagcagcagagcacctgcctggaatgcacaagcccctgtgtcccatccccatcggtggttagccgctaatagtttctgtcgctgctgggctccttgcctcctgcacgcttcactgtgcccttgaccgtgtgtgtgggtcaggctctgacggtgctgcgcttctttgcagatcgaggagtcggtgcgtgacatggtcatgcgctatggcagccgtctgtggaagctccgagtgctgcaggccgaggttaagatcaacatccgtcagacaacctcagatagtgccatccccatccgcctcttcatcaccaacgagtctggctactacctggacatcagcctctatagagaagtgacggactccagatccggaaatgtaagggcgcaccagctagggtcttgagcccagatgttccaggcatcagtggaagccaccttggatcatggcagcttccagtagatggcttcagggcgtggtggatgtggtagttttctgtttgtccatcctcctaagcagaaccattggcccccttggcagagtccatcctggggccacgtcgccggtgggcagtggagtgtgtggccattaaccgtgcagagctcactgccactggtccgacagagagacatgtttcccccaaacaccttgcagaaacgagccccagactattttacatgtgcatgcgtgtatcaatacacatgtgttcctgcctctgtgtgtatccacgcactctttaaagttgaaatgatgaaactcaaaactctcgagttgcaaaggtagtgcagaacgaaatattagctgaggtctacgctaacccagcttcccccaaggacatgatgcagttgaccatagcgtgctacctaaactgtaaagtgacacaggtgtccttctgattgctcaggtacagaccgcacgtagattcccatggttcttatctgcataccttgtgggtgaggctctgtctcccacaggctcagttcccacgcggcaaagggcgtgatctctgcacagtggatctgcctctccactgaacttttgttgccaggactcaggttggggtgggactcaaacctaggtccactagaagagcagccagtgctcttaacctctgagttgcctctccagccccttcccgtcttctttctttctgtccagatcatgtttcattcctttggcaacaagcaaggtagcctgcatgggatgctgatcaatacaccctatgtcaccaaggacctgctccaggctaagcgattccaggcacagtccctcgggaccacctatgtgtacgacttcccagagatgttcaggcaggttcgtctcacgggctcagacgtgaagcctttcccctccttccatgggaatccatcccttgtcctaagttatgcttctgagaccggttctagatgaggtcttcctaggacgaattaattcatgctgggatgactgacttcatggtactttctctccccgagacaaattgaactttagcttgttaagtgatgtgctatatagaagcttaggaagcaaagggaatcgggtggggggggggatctcgtaatcaataatgacgtgtgacaaattgttcaacattttaatctttgcttctgggttgtttgtgtatttgcgtgtgtatgtgtgtgtgtgtgtgtgtctgtgtgtgtgcgcgtgcgtgcgcgtgcaacatcaggtattttctttgttctccatcctgttttttgagatagggtctctcagttaacctggaggttgccaccaggttttctccagtctccatctcctcagctctatgggattaaccctggtccttatgcttttgaggaccccactttactgcctgtgccatcacctccagcccctacttctgatctgtttgcacgtttatatgttaactgctgcctgccagccctactctgaggctaggcagaccctggaacggaggcgggacatgcatgcatgtgcatatatatatatgcagtgtacattttgctttaaagtaattagtcccttgataaccaagaagtcacaaaaacagtacagggaaaaaagaatgagccatttccccagggacacattctgataagtcacagtgtgcggtgacacaggaaatcgacactggtgcaattgatactggctttgaggaatcttagtcctaccctgatcccagtgtctgggatccaggtgcagtggcacctgtctgcagtctcagctgttcagaaggctgagacaggggcatcactcgatgggagttagaggcctgcctatataacctagtgagagtctgtctcagaagaaaatattaggtttttctgactatccatttagaccagcagttcccaacctggggatatagacccctgcagggtttgaacgaccctttctcagggattgaatatcaggtatcctccatatcagatatttatattgtcatttatcacagtagcaaaattagacttaagaagtagcaacaaaaataatgctatggttcgggggaggggtcaccgcaacacgaggaactgtattaaaggctcacaacattaggaaagttgagagccattgatttagatcctgtagaaaggaaggggtaagggacataaagtatcacccatctgtgacacgcccaccagacccagcatctgactcccctggcacacatgggcacatgagtgcagggtttctctgttcttcttcttgtgcatgcatgccgagtttattcacaccatgttacatgcatccaggggccagctgagcccagagggtgttggatcccctgaaactagagtcatggatagttgtgagcttcctaatgtgggtcctggggcctctggaggaaccataaatctctcttaaccattgagctatctggtaccaagctgagtcaatactttgaaaaatacattctggctggagaagtggctcagtgggtatcaggcttgtcacacgggagtgacagcccgagttcagacctccagggcacccacattaaaaaaaaaaaaaaagccaggcatgggagagtgcacgagaaattctgagctcttggaggcagacacagggggatttctgggacttgctggcagtcagtctagacagtaagtgagctcggggttcagtgagtgtgtgtggtgtgtgtatgtgtgagagagagagacagagacagacagacagacagactgtctcaataaaaggggatggggagtgtgattgaagacctggcactctgacatgtcacctccaaccaggaagggcagcactttccctacccacgactacaagcttttcctctcccccaggctctctttaaactgtggggctccccagagaagtaccccaaagatatcctgacatacacagagctggtgttggactctcaaggtcagctggtggagatgaaccggcttcctggttgtaacgaggtaggaggtgaacgtgaggctgggcccggcagaactcagctggggtcagcttgctttagatgtcgtctggaagaacctggaggcatttcaattagccttcatctcattcccaggtgggcatggtggccttcaaaatgaggttcaagaccccggagtatccagaaggccgggacgccgttgtcatcggcaatgacatcaccttccaaatcggctctttcggcataggggaggacttcctgtacctgcgagcgtctgagatggcccggacagagggcatcccccaaatctacctggcagctaacagcggggcccgtatgggcctggctgaggagatcaaacagatattccaagtggcttgggtggacccagaggatccccacaaagtacgtcagatgtgggggtggcggtgtgatgcttacctaggtagatcatccctaacccaaaagcctccttatgagaaacacttccggatccaaagcttaggtatcagtgtgacgtcccaaacagaaagtctcacccaacttcactcgctgagtttcagtcagaacgcaagtacctgaagatgctgtacgtgaggtatctgagtaacacgggtgaatgttgtgtttagacttggtacctcactccctggatatctcattatatgcagatatgcccgcctgaaaaaaaattcaaaatctaaactgcttctgaccgcatgcaggtaagagaggcagagcccacatagcattgatagggtgtcaaggttcctgtgagacggtgggaaaggggctgtaagcccactgtcagttatgtaactcagattcactgagacaggcacagtgccacatgtgtgtctgagccgtggggaggctgaggcagaaggatagagttcacagccaggctggcctatgtagtgagacctgtctaactcacacacatgcacacacacacacacacacacacacacacacacacacacaagcaacatcaagaaacaaatgctttgggacatagtgattatcaggaaatggcttaaaaacacccctttaggggaatgacagcaagaacttgtagatatgtaggtgacatgcgatggcttctaaatccatgtgtacccagaatgcaaagtgagtgatgtcccacaccagggccttagatcatgtgtgtctgcacatgtgggtgcatgtgtgagggcacacatgtgcatatgtgagggtgcatgtgtgtctgcacatgtgggtgcatgtgtgagggcacatgtgtttgtgtgtgcatgtgtgagggtgtactgtatacatgtgtgtgtgcacgtgaggatgcatgtgtgtgtctgtgcacactgtgtgtgtgcacgtgaggatgcacgtgtgtgtctgtgcacactctgtgtgtgcacatgggtgctaacgtgcatgtgtatatatgtaggtacatgtgtgaaggtgtgtgtgtgtgtgtgtgtgtgaacaggtcctcctctgcttgggatctgccagggcttctaggctaggtgacaagcaagcttccagggctccttcctctccaccccctctcctgtcactgtaggcactcagccctgatgtgaggcagcagggtggggtggccactctcacacagaacatgtcctttagacagtgacgctgtttccctacagtagaaaaaagcactttgggagtcaaaaattaattttctattttaaaaaaatatatatctttagggtagtctcagtttaaacatctgaaatccaaaatgctctgtaacctgaaaccttttggtcactaatctcatccctaaagtaccaaattttacccacacctgtgctcataggatgggtccccatgaaaacacacagaaatatgacagtatgttatggggttatatataggctctccataggccatttataggttacatataggttatacctttagcctcgcagttctcaacctgtgggtcacaaccactggaaaacacacatttctgatggtcttaggaacccttgaccacaaatttattttcgttactgcttcatacctgtaattttgctactgagctcagttcctaagatcagaaatatgtgttttccaacagtcgtggcccacaggttgggaacagctgctgtacacaataagtgcctaccaaacatgaatgagacgatgtctcagtaggtagaagcaagtattccaaaactggacatacttacatctgaaacacttccagaccctcagattagggctgtccgacctgtatacactgacacacatgtacacatgtgggcaacacatttcctagacagtatgtaaccagacagagtgtgaggctgtaaggaagagagaagctcagagtagccccgtggttggcgggtggtgtgagcctgcggtgtgtagctgtacagctgatgctgtccacagccgccatggacgttgttggcaccttagaccatctggtggtcgtggagtccacggaacaggacccaagactcactgaagtgtgtttttaagggatttagatacctgtacctgacgccccaagactacacccagatcagttcccagaactcagtgcactgcaagcacatcgaagatgaaggcgaatccaggtaatctcggggttgacagtcaagccctagtgtagtcacagttcaccttagctgcctgtgtgcggtgctaatatcttaaccaattgggacaatctcctggttacctccaaatgattcagtcctccctccctctctccctccctctttctctcctctttctttttctcagttgagctttctaagtactaggcaggtgctataccgttaagctataccctcagtgatgcatcctgtattcaaaatagcagctcatgtggggaaaagattgggttttaaaggttcgcctcttccccccttccttccattctttccctctctcctttcctccctcccttccccttccattctcttcttctctcccttcttcctttcctccctccctccttctctccctccctccctccaccttccctcccttccttccttcctccctgccctgccctatctgtctttctgtctctctgcctctctttcactctgtctttcttgagacagggtttctctgtgtagccctggctatcctaaaactcatgccataaaacaggctggcttcaaactcagagatccacctgcccctgcctcccaagtgctgggactaaaggtgtgtgccatcaccacccagtaaaaagttcacatcttatgaccagttatccaaaaagatacagtggtccctgggggacctctctccacagaccaaaggctaggctagtttcctgtgggatgtggggtagggtgtgtcattatcgacgtccgccttaatctttaggaagcgtgatacccagggccctgagccccatcttcattttgcctctgactgttttgggtcccagtgtttgactttgctcgacaccccccctccccccaaccccagacctgtgggaaacgtgcacttcctgtttttgttttgttgttgttttgagaggagccttgacgtcagccctgtttgaaccttgcagatacgtcatcgtggatgtcatcgggaaggatgccaacctgggtgtggagaacctgaggggctcgggcatgattgcaggagaagcttccctggcttatgagaaaacggtcaccatcagcatggtgagcgccttcctgctctcttccttcctttgcttctcttctgtgtgagcgtgcgcatgcatgcacacccgagtagaggccagagatcaacatcaggcatcttctatctatcgattttcacctgactttggggggagcagtgtctctctgattcaagaacttgccaatatgcctacagctggccaggcagcccccggagccccctgtctctgcctcaccagcactggagttagagcttcgaactgctgcgcctgagttttttgtagccattgagaatctaaactctcatacacgtcctcagcattcagtctgctcttctcaaaattgctgcatgagaaaacaggtttcttcgccctcctccaaggaagagacttctgctatttatgctcctgagaataatacacctgattacaccgccttcataaagacaatccttaaatcctctgcagacagtgaagatataccagcatagaaacctctccagatgtaatgcttcattcacaacagaggtgtagtgcaagagacacaggaaatggtgtatcctagaggaggacaccagagagctgagacagccaactgggtagccctagcttctgagtgtggccagctgtgagagcatacctttcctcttctccctcttccgaggattctgccaatgtccatctctgctgcttctcccacttcttgatcatccatgcttcctctaacatctctgtgatcccagccatcatcatctctttggacggctcccgcagggtggcctggatttctgggatcttcacaagactctgcgttgccttcatcacctctgtgctcttctgcagagagccagccactctccgggccgctagttggtttctcacgcccatgagcacagagttcatgtgtgctttggatgcagagagcttgctcacagctttccttgacctgatcttctccttggccagaaccacacagacttccttttggcccttcctttggctgcatctttctttctttcttttttttttttttaaagattttttttatttattatatgtaagtacactgtagctgtcttcagacactccagaagaaggagtcagaccttgttacagatggttgtgagccaccatgtggttgctgggatttgaactcaggaccttgggaagaacagtcagtgctcttacccgctgagccatctttccagccccggctgcatctttcacagacggttttactgtctcttctcgtctttggatatctcttatttgcctgtcgacaacgctcatttcctttctgatcctcagtggccatccttttttttttttttttttttttttttttagtttttggagacagggtttctctgtgtagccctggctgtcctggaactcactttgtagaccaggctggcctcgaattcagaaatctgcctgcctctgcctctcaagttctgggattaaaggcgtgcgccaccactgccgggctgactgattccattcttttcagatacaaatcacgatgtttactccttatgactatgacaaaaacacagaataatcaatttataaagagagaaggttaatttggagtttcaggggggccacgagatctcgtggtcttgacaacttgagcctcttatggggacataaggcagagcatcgttgctcaaccaggtagccaggggcaaaggaagctgctagtctctcatgattctcctggtgacagtcctccagtcccccagggaccctcacagggcccacctcttaagtttctactaattctaactgggcctctgaggagcatttcatttgcagataatagcagaagccaagctagagcaggtactggaagaaaaggagactctagccagaggtggtatatacctgtaatccccacacctgggaggtagaggcagaggcaggaggcagggggatcatcttttagagagttcaaccagctgtggctgtgcagtgagatgcccctctgtgtgtgtgtgtctccgtaggtgacctgccgcgcccttggaatcggggcttacctggtgaggcttggccagcgggtgatccaggtggaaaactcccacatcatcctcaccggagccggtgctctcaacaaggtgccgtaggcaagggcaggggagaggtggtgtggggacccggttacatctcactcagcagctgtctttgccggtgttccactgctgtgaagagacgccatgaccatggcaattcttagaaaggacaacatttaatgggggctggcttacaggttcagaggttcagtcctttattgtcacggcgggaaacatggtggcacacagccgtgatactggaggaggtagctgagagttctgcatcgggatgggcaggaaacaggaagagacagttggcctggcttgagtgcctgaaactttaaagaccaccctagagacaaacttcttccaacaaggccacacctccaacaagtccacaccccagcaaggccacaacccagtgaggccatgcctccatcaaggccacaccccaacgaggccacacctctaacaaagccactcccccaacaagacttcttccaatctggcgattaaagtggcgtcactttgcaggaaaccgagaaaagccccacaagtaactctgcatcttgtatgctttggggcgcttgtgttctggctcacctgcagttaattccccttgagcatgttttgttacctgcaggattttccacgtggctctggactctctgtgtttaattctcacgcagagcccacggagatgctccacgtgtggttcttgcagcagcacctgggtagacccactacagacctgctgcggaactctttagctgtcctgatctcaggggcgttgatggttcccaaattagactgcattttagaattgcctagagttcttagagacacagagaccaccaatgcctggccctccccctgaagaccctgaaggaattggtttgagtatagcctgccagcgttttagaatcttccaggtcatcctgacaggcagccatagcagaggactcagcaagaatgggtggctttgctaaccatgctatgtcaaagcaggtcctgggaagagaggtctacacgtccaacaaccagctaggtggcgtgcagatcatgcataccaacggggtctcccacgtcaccgtgccagatgacttcgagggggtctgcaccattctggaatggctgtcatttataccgaaggtgcggtgttccctggcaacctgaagcctgggcgcctgtgggggtaggctcctcccactctccctctcagatacccagccttgtgcgttgcttttggggaagctctgaagtatgttgtaaggacgtggggatgtgggtacgctgtctgccgatcctttgaaaaaggtgatgttggacaaagcgagcctcagacctcacagacagccttcatctgttcctggcttcctcatcaggagcagtaatcgtggggcagcctcccaatctttctgagccttcgttttcctcatctgggaagtgtgttaccatggtgatgagggggcctgatgcccagggcctcccctgcaaggctaccctggactatactgatcagttatccctagtcaccacaggaccaaccctgattagttatccatcgtcccatgggactgctctaactagtcttgactaggtaggtatttaggtctccgtttcttcaattgctctgcctagataatgctggtcccgagtggctcccagactctatctgaactctaacacacttaagtttcagaaaaaggtagacagcagttactaccgttttctagctggagcagtggcttggaagccccagtgaggggcactgttgcacagctagcaatgtgcacagaggggaaagtactcggatgccaccgcagggacagactggacggccctggccttcttttctaggacaatcgcagcccggtccccatcaccactccttctgaccccatcgacagggaaattgaattcaccccaaccaaagctccctacgaccccaggtggatgcttgcaggcaggcctcacccaagtaagtccctaagtttgttcccggggggggggggaaggggaacccccagacttggggctctttagtggatctaccgtaaagggcctctttgatggaagtgtttatgtatttcccatctcccaacagggggtgggtatgtgtgaggtcaaaggcaggactggagactggactctgggcttttcctgggccatggaccagtacggcttgcaaacagctcagtgtctggagccaagggtttgagttcagtgctggcgaggtcttccctccctaagtgctcagtgatgccacctccctcctgcctctttccctctggctagacttcacgagggagagtggcttctttcacatacacatatgacatcattgtgcacgcacatgcacgcacgttttctccctccacggggaatacctttgtctcttagaggtatgctctattacgaggatcgcccagatgggaaggctgaactgtcctgtcatccctggcccaggtctagatgttcatgtgccttcagctgtgtagttgtgcagacaagggcctctccacagcagaaggatccccatggcttctttgtttcatagagctctccctccagcggtatctcccactgtgtgctgtgtcctgtcaagtcagccctgagtcccaagtcagaggctgaagcaggagattccgttcccaggcatccaacctctactgtgcccttgagtcccctgctgccaggccttgcagttcttgtcagaatgacagccatttgtccccaccatggtccccaaccccagctctggctgcagtaccaatgtgaccgtgtgtctctctgggacacgaggtggcctgcttcctctcagggatactgagctgtagccagtgggccagaataaggttccaaggttgatggtcccttcctggaatctcaccttgtggggagaaggcattttctaaccctgccacctctgaggaggggcatctggggctgtgtatggggtgtcagcacgtctggcattatatgagcacttggagggagtttgaatacccccagaaatgaattcccgtcttgatgtagcttttgtaatcatggttttattttgtgttttgtttgggggttgtttgtgtgtttgtgtgtgtgtgtatatgtactctgtgtggtcttaagtagaaaagaacacaggcctattataaggtcaaagccatatcagtgtaccccgccaggcagacctgggcctccccagccctcagccagggcctccatccttttgcccacagctctgaaggggacctggcagagtggattcttcgaccatggcagtttcaaggaaatcatggcaccctgggcccagactgtggtgacgggacgagcaaggtaactcgagacaggtggactgcacatgtctgcccaccaggcatggggcctctcaggcactaggctggggctgccagggccctctcttcttggtccataggtttttctgaatgcgaagaacaaaatggaggaatggggaaatagctaagaagtgcttgccacgccagcaggagggcccgagtctggattcctggcacccacatgagaagccgggtgctgcatatgatattagagctagggttagggagtcagagcccagccacgctgctcgccactctcaggtggagagctccaggtaatgactgaccctgtgccataatatgagaagagaatgaggaagacagctggtagtgaactttacacacaggtacacacacatgcacgcacacatgcacatacatgtgtgcatacttacccacacatgcctacatgccatacacataggcacacgaacacatgcatgtgtgtacacagcatacacatgtatacacatgtacacacacatgaacacatgcacacacacatgtgcacatacacatgcatgcacgcatgcgcgcactcacacacacacacagtgtatgcttatacacctcacacagactccaaaaataaaaaagtaaaaataaaaatgcaagctgaacactgaggaaagctgggagcaggaggggtggtcctccccatccagtgccaaacagtcattcctgaaaacatgcatacatgtaacctcacatggcctgagcgggttacagttaggaatacatacgtatatgcgaatacatatatacatgcaatagcattaaaaggagaggccatgagtttaaaggagaggtgagaggggcatataggaggggtttgatggaaggaggaaagagaagagaagcattgtaattaaattaggatctcaacaataaaggaaagaaagccagtttggagaaacatgtcatggaaggtgaagccacctgtgcagtgggagcccacctgggccttagagcctctgccacctactgtgggggctgggaccttcgccccagatcagtcccacaaccatagggccccccaggaggtgtttccagagatgaacagcccacctcatcatgtcatacccatctctgtgccactccagccaccagggcactcttcccctccagtgtggcccaggctgggtcctctaacttaccattcggattcccagcatgatgtcatcgtgacatcacagccacaaatccaggcttcaccatgctccacctctatagcctggtttgtttcatggagatgttaatgcagtccaaaggattgctgcagccacaggagcagtgctgtgctgggcgcttcatgtgtgtcactgggtctcacgggcagtagacagcacagttataggcacaggaccgtgagatggctcaacaggtcacatgcttgtcccacagttcagttcctaagatcggcacgaaggtggaagacaacagaccccaaaaggccccttcactcattcagcacagcacatgtgtacacacacacacacacacacacacacacgttgtaaagtcatgagtcattggcctttagttatatgcctcctatttatttttgaaaccctttcatacaatccttgaatgaacccctccaccatggagccctccctaggaagagaccaccaacctggtagggtagcacgggtaaaggacagaggtgcagccgtggctccaggtgttgatagcccaggctgacaggtggtgacatcatggtcccatctaagccaggccctatggtacttgataatgctcatcccctccctggttttgagtaccggggctggaacccagagtccccccttgcccccgtgcatgtcaggcaaaaagctgtatcactgagttgtatcccaacatcctttgctgtgtgtttcaaggcagtgtcttgttgtgtggctcaggctggttttgaactcttgatcttcctgccttggcttcctaagtagctgggtcacagatctatgccaccaatcctggcttgcttcagccttttccctgtgtgactcagttcggtgcccaagctgcccagggtgtaactgctggccagatgtgatgatttaagtcataattcaggacggggaaatggctaggttgcaaagcacctgcctggcacatgccaagtcccaagcttcatcctagtgccaaaaaatctgaagtgagaggaggatgctgggaactgtgtgtgcatggcccgaggggaagatgtctcctgtgggttcagcaccgtcctgccctgactgttctcaccctagcggggcacctacagctccgcatggtccttagtgactcggtgctgcccctttgccttgcaaccagctcaccccacttccagccctcgttgccacctgaacaggcctggcagcagatggggtagaccccgaggccctgagctctgcctgcaggcagcccagtgctgagcccttgtgtgttcgccttgcaggctggggggcatccctgtgggagtgattgctgtggagactcggactgtggaggtggctgtccccgctgaccctgccaacttggattctgaggccaaggtgaggggccgggagccgtgaccactggggacaggagtagatcctttcatctggttcagagaagcctctgagagccagagagcagaggcctcaagtagagattggtctgggggctctgcctttctccctaccatatctccacgggacacatattccaatagtctgggtttctttccaggatggtaatggtccccattccccctctgctttactcctgttcctgggagctgcaatgaggtctcaactactgtgttgtcaggctgagcacgagaataggggacccattgaggtcctaaggttatggccatgctttgggtctctagggagccctggctttggtacatgtcctagtaagggttactattgtggtaaaacaccatgagcaaagcagcttggggaggaaagggttaatttggcttacacctccacatcactgttcatcgctgaaggaagtcagggcaggaacctggaggtcagtgtctgacctaagtgactctgtgcacagatcatccagcaggcgggccaggtgtggttcccggactcggcctacaagacggcgcaggtcatcagggacttcaacaaggagcgcctgcctctcatgatcttcgccaactggaggggcttctccggaggcatgaagggtaagccggccctttcatatgtgtcactgtggtgtctcttgatagtcccgggagtttcctggggtcacgtgatgggccatgcagagaggtctgctctgcgagttcctggatgacctgggtagtcctgtgtggatgaggaaggcgtatgtccatccaccttcctcagagctgagctatagttgcagtctctctaagtcaccaagaatgtccagagagataaggttcccaggtactgaggagctgaggtgggagagaggcatatctgggtgacctctctgcgtccccagacccttcctttgtgaatggagaggaccgcagcaagggtcccgtgcactggtcccacctgtaagctgttgtcacggtattgtagtgtcaccagatcgggtgtggggatgtggagcagagggggctgcgtgtaccagataggtgggtgagcttgggcgtccccatgcttgagttgacagatgaagacacactcactcatgcaggagaatagcctgcccaaggtcacatgggccctgagggaggggaccagacctggaccagaccagactctccaagcctccctcaggagcccagggcagagaaggctgcaggaggctttgtgggtgcgtcactggggcccgagtctcctaagcaggcctcgctttgtagacatgtatgagcagatgctgaagtttggcgcctacatcgtggatggtctccgcctgtacgagcagcccattctcatctacatccctccctgtgcggagctccgtgggggctcctgggttgtcctggactccaccatcaaccccctgtgcatagagatgtatgcagacaaagagagcaggtgagcaggtgtcacctacagtgtcttggcagagttagttagggctccagaggacaaacccagaccaaggtaagaagccggccgcggcagtgtgcactaacctgggccctgatggtagtgggcgttgattgggaaatccctggggcttgctggctagtccgtctaaccaaatcagtgagagaccctgcctcaaaatgtaaggtggaccccttacattgacctatgatctttacaggcatgtacgcagatacacatacacaacacacacaaagtcataaggcgttaaaagaaataagtaagtaaagagaaaacaaaaagagcccagggcaggagtatctgtcctcagcccctccccctgtcctctcctctgtccagggggggtgttctggagccggagggcacggtggagattaagttccggaagaaagatctggtgaaaaccataaggaggatagacccagtgtgtaagaagctcgtgggacagctgggtaagtgggtcccacactctccacccccaggtcccacaggctccacccccaagccacacaggctccacccccaagccccacagctccacccccaggtcacacagacttcaccctcagatcacacaggctccacccccaagtcacacatgtgccatgcccaggtcacataggagccacctgcaggtcagcagaggcgccaattctagtgcattaagggtaaaatgagcgtgtatcaaactgtgagaccccaaagccggcccacatttgcaatcggcccgttccacaggatgctgcaagtggcagatgcaagtgggaagtttcggtttgtgtgtcctcggtgagatggcttggcagagggacccagacatgaaaacgaaattaattttcagagctgtgttctgaccacagcccatctctggggccggggtggaacgttcctttgtggcaggctgtctgcacccagaggttcgggctctggcgcgattgaggtgagggatgctcatcctgtaatcacataatcagcgcgctgtcccatatgcatggcgtgacacggttgaatcagttggggtccacgggggacaccagaacatggtgatgataatgtccctttagagtccccagccagagagaaacacttttatagattttatttggtgaatgccttactttgcttcactcctctgatgtcagtcattacggtgtgtaacgtccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctctctgtgtttctctgtttctgtttctctggtgtgtgtctgtgtttctctctctctgtgcatgtctgtctgtctgtctctctctgtgtatgtgtgtgtgtatgtgtctctctgtgtttgtgtttctctctgtgtgtatgtgtgtgtctgccacagcacgtgtgcggatgtcaggacaacttgcaagaatctattcgctcctcccaccatgtgggtcccggaaatcaaactcaggtcattaggcttggcagcaagcaccctttctctcctgagccatcttgctggcccccttattaggactctaagtgtggatttccttgttaaacagtgctgtcttcatccctacccatcccctcccctggcagaactgtggcatggagttagcatatctccactgtatttattatctgtctgaaaacaagagctgatggtatgctgaagcccggggcaaggctggggttttacccagatgctgtctcggggctgtgattgcatttccaaggctgcaggacaacttaatttaggagcagtgttggcatcgcagcccggactctcgcagggcagggcctcttgtctgtggtttttcaaataaaacaaaaacccaagaaaatccaccccagcccccacatggctacccctcacagcccctgaaaatcctaactgctgtctgctcacctgcagggaaagcccagcttcccgacaaggaccggaaggagctggagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccatctaccaccaggtggcagtgcagttcgcagacctgcacgacaccccgggccacatgctggagaaaggaatcatttctgtaagggttccccacggcccccaccggatgcagaggaatacagaggagtttgggatggattcaattctgggctcagggggctgtgtgggcggttcagtctgagcatgtcagtaggagccggcaggcgctcatccccctacactggacatccccgcttataggacaaggtgggcaggaaccaggtagccatcttggggcacggccttggccatttccctccccctcccccactcctctgtgggtgctcaggcggccatgtccacaggatgtgctggaatggaagactgcccgcaccttcttctactggaggctgcgccggctgctgctggaggcccaggtgaagcaggagatactccgagccagccccgagctgaaccacgagcacacacagtccatgctgcgacgctggttcgtggagactgagggcgctgtcaaggtgggcctgagcagggagagggaagccccagcatgcaggcaccaggggtctgggggctgctggctgccgcacctgcagcagcatctctgcctgaggtagactgtacccattgatccccaggcctacctgtgggacagcaaccaggtggtggtccagtggctggaacagcactggtcagccaaggacggcttgcgctccaccatccgtgaaaacatcaattatctgaagcgggactctgtcctcaagaccatccaaaggtgagtagcgtggcgtgagctgggtctaggtggggcttgtgtcatggctagcacatgactggtgaggaccctgccccagacctgggggctgaggatactggcttcctccctcacagtcattctgtagcctccaaggaggtggctcacaggacacctggaaccctgcctggcgtataaagctgggactcaggggtatgtcactcctcagatcataccacacaactggagactagaaagggctatatatgccaccttgaggcattctgtctccaagtcagaatcccgtgtaggattgtctgtcccctctctctctacctccttcccccactccccccttccctgtgtgagcacagcaagagaaactctgggctctggcctactcaagagcaacatggtgccctggacaaagacacttagaggcactgaactgagtgacaaaagtgaccccgccccctgtcccctttatctctccttccctgtagtctggtccaagaacatccagaggtcatcatggactgcgtggcctacctgagccagcacctcacgccagccgagcggatacaggtggctcagctgctgtctaccacggagagcccagcttcctcctgatgagcaactctggccatccccaggaccctggacggtgggatggccatgcggcaggccttcgagggacacgggcttattttgggaaaactcacggagccactccaaatgtagctgcggttcctgaccagcgacttctggacagaaggcccctgggcccctgctaaggcgggcccagcctctcctcacctggggacttcagggtttgtcccagtggataattctgccactgcctctctgaggccaactgaaccaggcacaccgagttccttgtggtttttgcctgaggtggggatccggtgtctgatcacaagacacttgttctaccacgttggtttgcactcagctccttgtgtccctcagccgagtaaatgggccaaagagaacgccagatgagacccaagaaaacgtctttttgtgatgaggcttattagacacttagcaagagcaaaaatgatttccttttttgttgttgttgttgtttttcatttaagagaataaagtgacattttattctccaagtggccctagtgagtcaggacaaccatctgtcccattagagaggttctccagagataaaggacaaacagacaggacacctagcattcagcatggctggaggagagttactgcctcggttcccaggctctgtaagccctctcttcccaagtggagcaaggactggacctccgtgcctcctgcagattggccacccacagggtactgagtgccctactgcctgagtgcagagaggctgtccctcacccctcccagaacctctggccaatatacttcctcaccttgtgccttgataccacggcaggagccaacagcgctggaccagtgacccagggctgtgcctcgaacactctggatccgcttacagagactttcccagcactgccaggcaccgcagcatcaggacccgaatgagatgctccggccaggggtggggtggggatgttggggtagtggagaaccccactctgtcgctgcccttcttgggggataaagggttcttctgggcaaggtcctcttgatgtggaggaaagcccagaccgacactggctgccaccctgaccacttgggtgcgctgaagaggctgctgaaagagctgcaaaataaactattttttttgaaggaagcttctggccttgatttattctgtggcacagaggagcccagcagttggcaggtgggggggagggggtagacggttctcagctcccctcagaatctccctctgtcaaacaccgaagggaggcccaggcagctttcacaccagttcccatccctttccatcacgaggatggcatgagctcagagaggtcaagacacttgcccacagtcacacaggatggaacggaaggtgtccagtctgtttgactgtcaagcccagccccttccttctgtgacacagaggtgtggtatgcctggactggtgatctacacttggaattgtctgtccctgaagtcttgccctgcataggaacccccccccccattatccctaacccaactcccccccacacacacagcttatctgttcatagggactgctcagtcttgactctcaaatatcagttactacttttcttctgatccagcatctttccc

SEQ ID NO: 19 - DNA, 20 bp, Artificial Sequence
  Antisense compound
gtgcgcgcgagcccgaaatc

SEQ ID NO: 20 - DNA, 24 bp, Artificial Sequence
  PCR Primer
ggatggtgttcactcggtaataga

SEQ ID NO: 21 - DNA, 21 bp, Artificial Sequence
  PCR Primer
gggtgatatgtgctgcgtcat

SEQ ID NO: 22 - DNA, 31 bp, Artificial Sequence
  PCR Probe
catcagcagagactacgtcctcaagcaaatc

SEQ ID NO: 23 - DNA, 20 bp, Artificial Sequence
  Antisense compound
acgagtatttcaaagtctta

SEQ ID NO: 24 - DNA, 20 bp, Artificial Sequence
  Antisense compound
accacatcctctcatcattg

SEQ ID NO: 25 - DNA, 20 bp, Artificial Sequence
  Antisense compound
agaccaccacatcctctcat

SEQ ID NO: 26 - DNA, 20 bp, Artificial Sequence
  Antisense compound
ccagaaagacctagccctca

SEQ ID NO: 27 - DNA, 20 bp, Artificial Sequence
  Antisense compound
atacctgcagtttgagccac

SEQ ID NO: 28 - DNA, 20 bp, Artificial Sequence
  Antisense compound
gggaagtcatctgcattgtt

SEQ ID NO: 29 - DNA, 20 bp, Artificial Sequence
  Antisense compound
atgtgttcaaatactgctgg

SEQ ID NO: 30 - DNA, 20 bp, Artificial Sequence
  Antisense compound
gttccatgtgttcaaatact

SEQ ID NO: 31 - DNA, 20 bp, Artificial Sequence
  Antisense compound
gacatcagccaccatctctg

SEQ ID NO: 32 - DNA, 20 bp, Artificial Sequence
  Antisense compound
tccccatggcaatctggagc

SEQ ID NO: 33 - DNA, 20 bp, Artificial Sequence
  Antisense compound
gataccccatacatcatacg

SEQ ID NO: 34 - DNA, 20 bp, Artificial Sequence
  Antisense compound
tcagcaaattcatgaagtcc

SEQ ID NO: 35 - DNA, 20 bp, Artificial Sequence
  Antisense compound
gagaatcagcaaattcatga

SEQ ID NO: 36 - DNA, 20 bp, Artificial Sequence
  Antisense compound
tcaccccgaatagacagctc

SEQ ID NO: 37 - DNA, 20 bp, Artificial Sequence
  Antisense compound
gaaagtcaccccgaatagac

SEQ ID NO: 38 - DNA, 20 bp, Artificial Sequence
  Antisense compound
agttcgaaagtcaccccgaa

SEQ ID NO: 39 - DNA, 20 bp, Artificial Sequence
  Antisense compound
gcaggaaggacttgacccct

SEQ ID NO: 40 - DNA, 20 bp, Artificial Sequence
  Antisense compound
tcatagataagttcaacatc

SEQ ID NO: 41 - DNA, 20 bp, Artificial Sequence
  Antisense compound
gttttattgccaattgtgat

SEQ ID NO: 42 - DNA, 20 bp, Artificial Sequence
  Antisense compound
cacaggttttattgccaatt

SEQ ID NO: 43 - DNA, 20 bp, Artificial Sequence
  Antisense compound
ggaaggcagtatccattcat

SEQ ID NO: 44 - DNA, 20 bp, Artificial Sequence
  Antisense compound
tactgagccatttccttctt

SEQ ID NO: 45 - DNA, 20 bp, Artificial Sequence
  Antisense compound
tagcatactgagccatttcc

SEQ ID NO: 46 - DNA, 20 bp, Artificial Sequence
  Antisense compound
cagatccatcaccacagcct

SEQ ID NO: 47 - DNA, 20 bp, Artificial Sequence
  Antisense compound
agggcgaatacacatttgtc

SEQ ID NO: 48 - DNA, 20 bp, Artificial Sequence
  Antisense compound
aactgatcaataagcattgt

SEQ ID NO: 49 - DNA, 20 bp, Artificial Sequence
  Antisense compound
ctctacttggttatggcgaa

SEQ ID NO: 50 - DNA, 20 bp, Artificial Sequence
  Antisense compound
tgcaggttctcaatgcaaaa

SEQ ID NO: 51 - DNA, 20 bp, Artificial Sequence
  Antisense compound
gtttctgcaggttctcaatg

SEQ ID NO: 52 - DNA, 20 bp, Artificial Sequence
  Antisense compound
gatgagtttctgcaggttct

SEQ ID NO: 53 - DNA, 20 bp, Artificial Sequence
  Antisense compound
gtgttgtccttaagctggcg

SEQ ID NO: 54 - DNA, 20 bp, Artificial Sequence
  Antisense compound
tcgctgacactagctacatg

SEQ ID NO: 55 - DNA, 20 bp, Artificial Sequence
  Antisense compound
tcagtcttgatagccacatt

SEQ ID NO: 56 - DNA, 20 bp, Artificial Sequence
  Antisense compound
ggaattctctatgaaatctc

SEQ ID NO: 57 - DNA, 20 bp, Artificial Sequence
  Antisense compound
tcaaacttatcccttgctcg

SEQ ID NO: 58 - DNA, 20 bp, Artificial Sequence
  Antisense compound
aaaatttctcatccggttca

SEQ ID NO: 59 - DNA, 20 bp, Artificial Sequence
  Antisense compound
aggtcaaaatttctcatccg

SEQ ID NO: 60 - DNA, 20 bp, Artificial Sequence
  Antisense compound
aatctttgatgggtccatga

SEQ ID NO: 61 - DNA, 20 bp, Artificial Sequence
  Antisense compound
tgattttcagttctgcctgg

SEQ ID NO: 62 - DNA, 20 bp, Artificial Sequence
  Antisense compound
aatgttgattttcagttctg

SEQ ID NO: 63 - DNA, 20 bp, Artificial Sequence
  Antisense compound
tgtcaggaagaggcggatgg

SEQ ID NO: 64 - DNA, 20 bp, Artificial Sequence
  Antisense compound
cagactcgtttgtcaggaag

SEQ ID NO: 65 - DNA, 20 bp, Artificial Sequence
  Antisense compound
attccatgcagtggtccctg

SEQ ID NO: 66 - DNA, 20 bp, Artificial Sequence
  Antisense compound
gccgaaacatctctgggata

SEQ ID NO: 67 - DNA, 20 bp, Artificial Sequence
  Antisense compound
gttatcttgtacctggattc

SEQ ID NO: 68 - DNA, 20 bp, Artificial Sequence
  Antisense compound
cggacaaggtaagccccaat

SEQ ID NO: 69 - DNA, 20 bp, Artificial Sequence
  Antisense compound
ccagccggacaaggtaagcc

SEQ ID NO: 70 - DNA, 20 bp, Artificial Sequence
  Antisense compound
ttctcaacctggatggttct

SEQ ID NO: 71 - DNA, 20 bp, Artificial Sequence
  Antisense compound
ggaacaaactcgatgattct

SEQ ID NO: 72 - DNA, 20 bp, Artificial Sequence
  Antisense compound
ttgtgggaacaaactcgatg

SEQ ID NO: 73 - DNA, 20 bp, Artificial Sequence
  Antisense compound
ggttgggtgaggacggcctg

SEQ ID NO: 74 - DNA, 20 bp, Artificial Sequence
  Antisense compound
gttcgggtttctacagcaac

SEQ ID NO: 75 - DNA, 20 bp, Artificial Sequence
  Antisense compound
tggttttcaccagatccttt

SEQ ID NO: 76 - DNA, 20 bp, Artificial Sequence
  Antisense compound
acgcatggttttcaccagat

SEQ ID NO: 77 - DNA, 20 bp, Artificial Sequence
  Antisense compound
gtgcaagtcagcaaactgca

SEQ ID NO: 78 - DNA, 20 bp, Artificial Sequence
  Antisense compound
gtgtcgtgcaagtcagcaaa

SEQ ID NO: 79 - DNA, 20 bp, Artificial Sequence
  Antisense compound
attttcttcttgaccaggtc

SEQ ID NO: 80 - DNA, 20 bp, Artificial Sequence
  Antisense compound
aagctcttcctacgtggaag

SEQ ID NO: 81 - DNA, 20 bp, Artificial Sequence
  Antisense compound
ctagttgttgaaagtaaact

SEQ ID NO: 82 - DNA, 20 bp, Artificial Sequence
  Antisense compound
gatttgatttattgcaaaaa

SEQ ID NO: 83 - DNA, 20 bp, Artificial Sequence
  Antisense compound
acttgtagatatgtgggatt

SEQ ID NO: 84 - DNA, 20 bp, Artificial Sequence
  Antisense compound
gtagaggtttatttcaacaa

SEQ ID NO: 85 - DNA, 20 bp, Artificial Sequence
  Antisense compound
ccagaaagacctcagggtgg

SEQ ID NO: 86 - DNA, 20 bp, Artificial Sequence
  Antisense compound
ctatagtctttttgtctaat

SEQ ID NO: 87 - DNA, 20 bp, Artificial Sequence
  Antisense compound
catgctggacctttgaagca

SEQ ID NO: 88 - DNA, 20 bp, Artificial Sequence
  Antisense compound
atttcaaagtctttgaagca

SEQ ID NO: 89 - DNA, 20 bp, Artificial Sequence
  Antisense compound
gacatgctggaccttgaaaa

SEQ ID NO: 90 - DNA, 20 bp, Artificial Sequence
  Antisense compound
caagccagacatgctggacc

SEQ ID NO: 91 - DNA, 20 bp, Artificial Sequence
  Antisense compound
accacagccttcatgtggcc

SEQ ID NO: 92 - DNA, 20 bp, Artificial Sequence
  Antisense compound
ctcacctcacctcagggtgg

SEQ ID NO: 93 - DNA, 20 bp, Artificial Sequence
  Antisense compound
aaatgacctggagcatagat

SEQ ID NO: 94 - DNA, 20 bp, Artificial Sequence
  Antisense compound
taacacttacctttgaagca

SEQ ID NO: 95 - DNA, 20 bp, Artificial Sequence
  Antisense compound
atttcaaagtctgaggatac

SEQ ID NO: 96 - DNA, 20 bp, Artificial Sequence
  Antisense compound
gtacccacaccttgaaaatc

SEQ ID NO: 97 - DNA, 20 bp, Artificial Sequence
  Antisense compound
cttcagcatctggtagatac

SEQ ID NO: 98 - DNA, 20 bp, Artificial Sequence
  Antisense compound
ccatgccaatctggaaaggc

SEQ ID NO: 99 - DNA, 20 bp, Artificial Sequence
  Antisense compound
gatggaaccaggacctatgt

SEQ ID NO: 100 - DNA, 20 bp, Artificial Sequence
  Antisense compound
gctctctctgcttctgctag

SEQ ID NO: 101-104 - skipped (4 entries)

SEQ ID NO: 105 - DNA, 18 bp, Artificial Sequence
  PCR Primer
cgtgcccatcagcatcac

SEQ ID NO: 106 - DNA, 19 bp, Artificial Sequence
  PCR Primer
gaaggctaccatggctccc

SEQ ID NO: 107 - DNA, 23 bp, Artificial Sequence
  PCR Probe
ccctgacctgctgaggcacagca

SEQ ID NO: 108 - DNA, 20 bp, Artificial Sequence
  Antisense compound
agacaaagaagcaagaccat

SEQ ID NO: 109 - DNA, 20 bp, Artificial Sequence
  Antisense compound
ccagatttttaaccaggaaa

SEQ ID NO: 110 - DNA, 20 bp, Artificial Sequence
  Antisense compound
ttcccccagatttttaacca

SEQ ID NO: 111 - DNA, 20 bp, Artificial Sequence
  Antisense compound
tcatcagctgcctcttgatg

SEQ ID NO: 112 - DNA, 20 bp, Artificial Sequence
  Antisense compound
cggaacatctcataggccca

SEQ ID NO: 113 - DNA, 20 bp, Artificial Sequence
  Antisense compound
gggattctcttggcaatgtc

SEQ ID NO: 114 - DNA, 20 bp, Artificial Sequence
  Antisense compound
ggcccacatggcctcactgg

SEQ ID NO: 115 - DNA, 20 bp, Artificial Sequence
  Antisense compound
atgagaaagatgggcgagcc

SEQ ID NO: 116 - DNA, 20 bp, Artificial Sequence
  Antisense compound
gcttcatgagaaagatgggc

SEQ ID NO: 117 - DNA, 20 bp, Artificial Sequence
  Antisense compound
ggccagcttcatgagaaaga

SEQ ID NO: 118 - DNA, 20 bp, Artificial Sequence
  Antisense compound
gcagggatgttccacctgca

SEQ ID NO: 119 - DNA, 20 bp, Artificial Sequence
  Antisense compound
ggcacgcccatggcgatctg

SEQ ID NO: 120 - DNA, 20 bp, Artificial Sequence
  Antisense compound
gcaatgacgtggcctcgggc

SEQ ID NO: 121 - DNA, 20 bp, Artificial Sequence
  Antisense compound
gtctgggttttcgctggtga

SEQ ID NO: 122 - DNA, 20 bp, Artificial Sequence
  Antisense compound
gctgaagtaaccccacacgt

SEQ ID NO: 123 - DNA, 20 bp, Artificial Sequence
  Antisense compound
gccacgctgaagtaacccca

SEQ ID NO: 124 - DNA, 20 bp, Artificial Sequence
  Antisense compound
ttctggaagctctcggtctc

SEQ ID NO: 125 - DNA, 20 bp, Artificial Sequence
  Antisense compound
cgttgttctggaagctctcg

SEQ ID NO: 126 - DNA, 20 bp, Artificial Sequence
  Antisense compound
atctacgaggttcagtagtg

SEQ ID NO: 127 - DNA, 20 bp, Artificial Sequence
  Antisense compound
ctgccgggccaccttgagaa

SEQ ID NO: 128 - DNA, 20 bp, Artificial Sequence
  Antisense compound
gggtcatgatcatcttcatc

SEQ ID NO: 129 - DNA, 20 bp, Artificial Sequence
  Antisense compound
gttcagggtcatgatcatct

SEQ ID NO: 130 - DNA, 20 bp, Artificial Sequence
  Antisense compound
ttgatgtacttcacccggcc

SEQ ID NO: 131 - DNA, 20 bp, Artificial Sequence
  Antisense compound
gccacgctggtcatgatctc

SEQ ID NO: 132 - DNA, 20 bp, Artificial Sequence
  Antisense compound
tgggccatcaccctgcggac

SEQ ID NO: 133 - DNA, 20 bp, Artificial Sequence
  Antisense compound
tccaggatggtggctatctg

SEQ ID NO: 134 - DNA, 20 bp, Artificial Sequence
  Antisense compound
ggcagtccaggatggtggct

SEQ ID NO: 135 - DNA, 20 bp, Artificial Sequence
  Antisense compound
gctgcggtatctctggacca

SEQ ID NO: 136 - DNA, 20 bp, Artificial Sequence
  Antisense compound
gcttgctgaaaatggtgctc

SEQ ID NO: 137 - DNA, 20 bp, Artificial Sequence
  Antisense compound
agtgggcttgctgaaaatgg

SEQ ID NO: 138 - DNA, 20 bp, Artificial Sequence
  Antisense compound
agctggttcttcttggccac

SEQ ID NO: 139 - DNA, 20 bp, Artificial Sequence
  Antisense compound
tcaccagctggttcttcttg

SEQ ID NO: 140 - DNA, 20 bp, Artificial Sequence
  Antisense compound
tctgggccacacagctcatc

SEQ ID NO: 141 - DNA, 20 bp, Artificial Sequence
  Antisense compound
aactggtggccgtacatgtc

SEQ ID NO: 142 - DNA, 20 bp, Artificial Sequence
  Antisense compound
ggcagaactggtggccgtac

SEQ ID NO: 143 - DNA, 20 bp, Artificial Sequence
  Antisense compound
tcttctgcaaactcatctct

SEQ ID NO: 144 - DNA, 20 bp, Artificial Sequence
  Antisense compound
cagctggaaggccagggcag

SEQ ID NO: 145 - DNA, 20 bp, Artificial Sequence
  Antisense compound
tggttggcacagggcacggc

SEQ ID NO: 146 - DNA, 20 bp, Artificial Sequence
  Antisense compound
aggaggcttcctttgtgatc

SEQ ID NO: 147 - DNA, 20 bp, Artificial Sequence
  Antisense compound
agatccttggtgacgtaggg

SEQ ID NO: 148 - DNA, 20 bp, Artificial Sequence
  Antisense compound
ggagcagatccttggtgacg

SEQ ID NO: 149 - DNA, 20 bp, Artificial Sequence
  Antisense compound
gtttaaagagagcctgcctg

SEQ ID NO: 150 - DNA, 20 bp, Artificial Sequence
  Antisense compound
tgttggatgtgtagacctct

SEQ ID NO: 151 - DNA, 20 bp, Artificial Sequence
  Antisense compound
ccaggatgtcagatatgacg

SEQ ID NO: 152 - DNA, 20 bp, Artificial Sequence
  Antisense compound
accaggcctcggatggtctt

SEQ ID NO: 153 - DNA, 20 bp, Artificial Sequence
  Antisense compound
cacggtcatcagtcaacaac

SEQ ID NO: 154 - DNA, 20 bp, Artificial Sequence
  Antisense compound
gctcggaaccagtagccctg

SEQ ID NO: 155 - DNA, 20 bp, Artificial Sequence
  Antisense compound
tcaacctcttccttcatgta

SEQ ID NO: 156 - DNA, 20 bp, Artificial Sequence
  Antisense compound
agaagatgcagtccagcacc

SEQ ID NO: 157 - DNA, 20 bp, Artificial Sequence
  Antisense compound
tgccgcagctcgtaggaggg

SEQ ID NO: 158 - DNA, 20 bp, Artificial Sequence
  Antisense compound
ccggtgctgcaggctgttta

SEQ ID NO: 159 - DNA, 20 bp, Artificial Sequence
  Antisense compound
agaggctgatgtccaggtag

SEQ ID NO: 160 - DNA, 20 bp, Artificial Sequence
  Antisense compound
aagagagcctgcctgaacat

SEQ ID NO: 161 - DNA, 20 bp, Artificial Sequence
  Antisense compound
ccacagtttaaagagagcct

SEQ ID NO: 162 - DNA, 20 bp, Artificial Sequence
  Antisense compound
gagccccacagtttaaagag

SEQ ID NO: 163 - DNA, 20 bp, Artificial Sequence
  Antisense compound
cggttcatctccaccagctg

SEQ ID NO: 164 - DNA, 20 bp, Artificial Sequence
  Antisense compound
gaaggccaccatgcccacct

SEQ ID NO: 165 - DNA, 20 bp, Artificial Sequence
  Antisense compound
attttgaaggccaccatgcc

SEQ ID NO: 166 - DNA, 20 bp, Artificial Sequence
  Antisense compound
acctcattttgaaggccacc

SEQ ID NO: 167 - DNA, 20 bp, Artificial Sequence
  Antisense compound
tctgggtccacccaagccac

SEQ ID NO: 168 - DNA, 20 bp, Artificial Sequence
  Antisense compound
caggaccttgttgagagcac

SEQ ID NO: 169 - DNA, 20 bp, Artificial Sequence
  Antisense compound
cttcccaggaccttgttgag

SEQ ID NO: 170 - DNA, 20 bp, Artificial Sequence
  Antisense compound
cctctcttcccaggaccttg

SEQ ID NO: 171 - DNA, 20 bp, Artificial Sequence
  Antisense compound
gtgtagacctctcttcccag

SEQ ID NO: 172 - DNA, 20 bp, Artificial Sequence
  Antisense compound
ttcagagttgggtgaggcct

SEQ ID NO: 173 - DNA, 20 bp, Artificial Sequence
  Antisense compound
atgatttccttgaaactgcc

SEQ ID NO: 174 - DNA, 20 bp, Artificial Sequence
  Antisense compound
gtgccatgatttccttgaaa

SEQ ID NO: 175 - DNA, 20 bp, Artificial Sequence
  Antisense compound
ccagggtgccatgatttcct

SEQ ID NO: 176 - DNA, 20 bp, Artificial Sequence
  Antisense compound
gtctccacagcaatcactcc

SEQ ID NO: 177 - DNA, 20 bp, Artificial Sequence
  Antisense compound
ctctctttgtctgcatacat

SEQ ID NO: 178 - DNA, 20 bp, Artificial Sequence
  Antisense compound
ccctgctctctttgtctgca

SEQ ID NO: 179 - DNA, 20 bp, Artificial Sequence
  Antisense compound
gatggtcttgaggacagagt

SEQ ID NO: 180 - DNA, 20 bp, Artificial Sequence
  Antisense compound
catgctcggcctgcagaata

SEQ ID NO: 181 - DNA, 20 bp, Artificial Sequence
  Antisense compound
agccacataccgggtggact

SEQ ID NO: 182 - DNA, 20 bp, Artificial Sequence
  Antisense compound
cacttggagagtcctctctc

SEQ ID NO: 183 - DNA, 20 bp, Artificial Sequence
  Antisense compound
tcagcacagcaggccccaca

SEQ ID NO: 184 - DNA, 20 bp, Artificial Sequence
  Antisense compound
cccaggcaccctacatgaaa

SEQ ID NO: 185 - DNA, 20 bp, Artificial Sequence
  Antisense compound
ggctcagggaggagaaggca

SEQ ID NO: 186 - DNA, 20 bp, Artificial Sequence
  Antisense compound
tccatagcgcattaccatgc

SEQ ID NO: 187 - DNA, 20 bp, Artificial Sequence
  Antisense compound
tccttatacaggctgatgtc

SEQ ID NO: 188 - DNA, 20 bp, Artificial Sequence
  Antisense compound
ttccttgaaactgccatggt

SEQ ID NO: 189 - DNA, 20 bp, Artificial Sequence
  Antisense compound
gagttcctctgctgactggc

SEQ ID NO: 190 - DNA, 20 bp, Artificial Sequence
  Antisense compound
tccaagtagtagccagactc

SEQ ID NO: 191 - DNA, 20 bp, Artificial Sequence
  Antisense compound
cgtgggatgccttctgctct

SEQ ID NO: 192 - DNA, 20 bp, Artificial Sequence
  Antisense compound
agaagatgcagtccagcacc

SEQ ID NO: 193 - DNA, 20 bp, Artificial Sequence
  Antisense compound
tgggttttcgctggtgatcc

SEQ ID NO: 194 - DNA, 20 bp, Artificial Sequence
  Antisense compound
ggttttcgctggtgatcctg

SEQ ID NO: 195 - DNA, 20 bp, Artificial Sequence
  Antisense compound
tggcctcttcacggttctcg

SEQ ID NO: 196 - DNA, 20 bp, Artificial Sequence
  Antisense compound
gcagggaggacctgacccct

SEQ ID NO: 197 - DNA, 20 bp, Artificial Sequence
  Antisense compound
tacgtagtgtaactgctgcc

SEQ ID NO: 198 - DNA, 20 bp, Artificial Sequence
  Antisense compound
acactggtcatgatctcctg

SEQ ID NO: 199 - DNA, 20 bp, Artificial Sequence
  Antisense compound
tgtgtgttcatgaagaagac

SEQ ID NO: 200 - DNA, 20 bp, Artificial Sequence
  Antisense compound
caccacagccttcatgtagc

SEQ ID NO: 201 - DNA, 20 bp, Artificial Sequence
  Antisense compound
ggaactccaccacacaggtg

SEQ ID NO: 202 - DNA, 20 bp, Artificial Sequence
  Antisense compound
ggcagcatgaactggaactc

SEQ ID NO: 203 - DNA, 20 bp, Artificial Sequence
  Antisense compound
atgtggttgcagtcagtgcg

SEQ ID NO: 204 - DNA, 20 bp, Artificial Sequence
  Antisense compound
aagttgaggaagatgtggtt

SEQ ID NO: 205 - DNA, 20 bp, Artificial Sequence
  Antisense compound
gtgggcacaaagttgaggaa

SEQ ID NO: 206 - DNA, 20 bp, Artificial Sequence
  Antisense compound
gggtccatgatgactgtggg

SEQ ID NO: 207 - DNA, 20 bp, Artificial Sequence
  Antisense compound
aggtagtagccagactcgtt

SEQ ID NO: 208 - DNA, 20 bp, Artificial Sequence
  Antisense compound
gatgtcattgccgatgacaa

SEQ ID NO: 209 - DNA, 20 bp, Artificial Sequence
  Antisense compound
gaagctgccatcctggctgt

SEQ ID NO: 210 - DNA, 20 bp, Artificial Sequence
  Antisense compound
cctcatctgggttttcgctg

SEQ ID NO: 211 - DNA, 20 bp, Artificial Sequence
  Antisense compound
ccccaggagaagcagtgccc

SEQ ID NO: 212 - DNA, 20 bp, Artificial Sequence
  Antisense compound
ccttccctgaaggttcctcc

SEQ ID NO: 213 - DNA, 20 bp, Artificial Sequence
  Antisense compound
gagtgctggttcagctccag

SEQ ID NO: 214 - DNA, 20 bp, Artificial Sequence
  Antisense compound
tctattttctttctgtctcg

SEQ ID NO: 215 - DNA, 20 bp, Artificial Sequence
  Antisense compound
acagtgaaatctcgttgaga

SEQ ID NO: 216 - DNA, 20 bp, Artificial Sequence
  Antisense compound
atcactttatttcccccaaa

SEQ ID NO: 217 - DNA, 20 bp, Artificial Sequence
  Antisense compound
atgcatttcactgctgcaat

SEQ ID NO: 218 - DNA, 20 bp, Artificial Sequence
  Antisense compound
gcattggctttaaggtcttc

SEQ ID NO: 219 - DNA, 20 bp, Artificial Sequence
  Antisense compound
ccccagccagcccacactgc

SEQ ID NO: 220 - DNA, 20 bp, Artificial Sequence
  Antisense compound
ccctctgaggccttgatcat

SEQ ID NO: 221 - DNA, 20 bp, Artificial Sequence
  Antisense compound
gcttgaacctgtctgaagag

SEQ ID NO: 222 - DNA, 20 bp, Artificial Sequence
  Antisense compound
gccaccatctctgtacaagg

SEQ ID NO: 223 - DNA, 20 bp, Artificial Sequence
  Antisense compound
atctggagctgtgctgcagg

SEQ ID NO: 224 - DNA, 20 bp, Artificial Sequence
  Antisense compound
gcagcagcaacactgaaata

SEQ ID NO: 225 - DNA, 20 bp, Artificial Sequence
  Antisense compound
ccgaatagacagctccttca

SEQ ID NO: 226 - DNA, 20 bp, Artificial Sequence
  Antisense compound
actgtagttcgaaagtcacc

SEQ ID NO: 227 - DNA, 20 bp, Artificial Sequence
  Antisense compound
agtctgtccagccagccagt

SEQ ID NO: 228 - DNA, 20 bp, Artificial Sequence
  Antisense compound
ggagtgaaggaagttagaga

SEQ ID NO: 229 - DNA, 20 bp, Artificial Sequence
  Antisense compound
ataagttcaacatctactgt

SEQ ID NO: 230 - DNA, 20 bp, Artificial Sequence
  Antisense compound
cgagtcaccttaagtacata

SEQ ID NO: 231 - DNA, 20 bp, Artificial Sequence
  Antisense compound
aaacacacaggttttattgc

SEQ ID NO: 232 - DNA, 20 bp, Artificial Sequence
  Antisense compound
ttctcaaacacacaggtttt

SEQ ID NO: 233 - DNA, 20 bp, Artificial Sequence
  Antisense compound
tttccttctcaaacacacag

SEQ ID NO: 234 - DNA, 20 bp, Artificial Sequence
  Antisense compound
gtcattttccttctcaaaca

SEQ ID NO: 235 - DNA, 20 bp, Artificial Sequence
  Antisense compound
tggattaacttcccagcaga

SEQ ID NO: 236 - DNA, 20 bp, Artificial Sequence
  Antisense compound
atcttcattacctcaatctc

SEQ ID NO: 237 - DNA, 20 bp, Artificial Sequence
  Antisense compound
gttgctagcatactgagcca

SEQ ID NO: 238 - DNA, 20 bp, Artificial Sequence
  Antisense compound
gtgatgttgctagcatactg

SEQ ID NO: 239 - DNA, 20 bp, Artificial Sequence
  Antisense compound
tgctggctgggaaactgaca

SEQ ID NO: 240 - DNA, 20 bp, Artificial Sequence
  Antisense compound
atgccacttcggtacctctg

SEQ ID NO: 241 - DNA, 20 bp, Artificial Sequence
  Antisense compound
gatgtgggcagcatgaactg

SEQ ID NO: 242 - DNA, 20 bp, Artificial Sequence
  Antisense compound
atgttccctctgtttggatg

SEQ ID NO: 243 - DNA, 20 bp, Artificial Sequence
  Antisense compound
agcctgtcatcctcaatatc

SEQ ID NO: 244 - DNA, 20 bp, Artificial Sequence
  Antisense compound
ctgaaatccttttgtgcaac

SEQ ID NO: 245 - DNA, 20 bp, Artificial Sequence
  Antisense compound
ttatcccttgctcggaatgt

SEQ ID NO: 246 - DNA, 20 bp, Artificial Sequence
  Antisense compound
aaagccagagcaggctccag

SEQ ID NO: 247 - DNA, 20 bp, Artificial Sequence
  Antisense compound
aggtgcatcttgtgattagc

SEQ ID NO: 248 - DNA, 20 bp, Artificial Sequence
  Antisense compound
cgaacaaagaacctgtagtc

SEQ ID NO: 249 - DNA, 20 bp, Artificial Sequence
  Antisense compound
atctttgatgggtccatgat

SEQ ID NO: 250 - DNA, 20 bp, Artificial Sequence
  Antisense compound
cgcattaccatgctccgcac

SEQ ID NO: 251 - DNA, 20 bp, Artificial Sequence
  Antisense compound
ttcagttctgcctggaggac

SEQ ID NO: 252 - DNA, 20 bp, Artificial Sequence
  Antisense compound
aggaagaggcggatgggaat

SEQ ID NO: 253 - DNA, 20 bp, Artificial Sequence
  Antisense compound
ctgtcctggagtcagtcact

SEQ ID NO: 254 - DNA, 20 bp, Artificial Sequence
  Antisense compound
ctgtgctgtcctggagtcag

SEQ ID NO: 255 - DNA, 20 bp, Artificial Sequence
  Antisense compound
atgatctgtgctgtcctgga

SEQ ID NO: 256 - DNA, 20 bp, Artificial Sequence
  Antisense compound
gaaacatgatctgtgctgtc

SEQ ID NO: 257 - DNA, 20 bp, Artificial Sequence
  Antisense compound
atctctgggatatcatatat

SEQ ID NO: 258 - DNA, 20 bp, Artificial Sequence
  Antisense compound
ccagcaatcattccagaacc

SEQ ID NO: 259 - DNA, 20 bp, Artificial Sequence
  Antisense compound
gttgggtgaggacggcctgc

SEQ ID NO: 260 - DNA, 20 bp, Artificial Sequence
  Antisense compound
ttggcttcagaatccaggtt

SEQ ID NO: 261 - DNA, 20 bp, Artificial Sequence
  Antisense compound
ttatcttggcttcagaatcc

SEQ ID NO: 262 - DNA, 20 bp, Artificial Sequence
  Antisense compound
gcctgctggattatcttggc

SEQ ID NO: 263 - DNA, 20 bp, Artificial Sequence
  Antisense compound
ctccagttggcaaagaccat

SEQ ID NO: 264 - DNA, 20 bp, Artificial Sequence
  Antisense compound
atttctactgtcccttctgg

SEQ ID NO: 265 - DNA, 20 bp, Artificial Sequence
  Antisense compound
cctcccgctccttcaacttg

SEQ ID NO: 266 - DNA, 20 bp, Artificial Sequence
  Antisense compound
tggtaaatgggaattaggaa

SEQ ID NO: 267 - DNA, 20 bp, Artificial Sequence
  Antisense compound
tgcaagtcagcaaactgcac

SEQ ID NO: 268 - DNA, 20 bp, Artificial Sequence
  Antisense compound
ttctcctgcatccggcctgg

SEQ ID NO: 269 - DNA, 19 bp, Artificial Sequence
  PCR Primer
aggtgctcatcgccaacaa

SEQ ID NO: 270 - DNA, 15 bp, Artificial Sequence
  PCR Primer
ccagcggcggatgga

SEQ ID NO: 271 - DNA, 24 bp, Artificial Sequence
  PCR Probe
catcgctgcggtcaagtgtatgcg

SEQ ID NO: 272 - DNA, 19 bp, Artificial Sequence
  PCR Primer
gggctccctggatgacaac

SEQ ID NO: 273 - DNA, 19 bp, Artificial Sequence
  PCR Primer
ttccgggaggagttctgga

SEQ ID NO: 274 - DNA, 25 bp, Artificial Sequence
  PCR Primer
ctctgatgaggaccctagtgccggc

SEQ ID NO: 275 - DNA, 21 bp, Artificial Sequence
  PCR Probe
ctggctgcatccattatgtca

SEQ ID NO: 276 - DNA, 21 bp, Artificial Sequence
  PCR Primer
gggttgtccagttgcattttg

SEQ ID NO: 277 - DNA, 23 bp, Artificial Sequence
  PCR Probe
ctggagcagcacttgaccctggc

What is claimed is:

1. A method of ameliorating or lessening the severity of a metabolic disorder in an animal, comprising administering to the animal an antisense oligonucleotide consisting of 12 to 50 linked nucleosides, wherein the antisense oligonucleotide is at least 85% complementary to human ACC1, human ACC2, or both human ACC1 and human ACC2, wherein expression of the ACC1, the ACC2, or both the ACC1 and ACC2 is reduced, and wherein administering the antisense oligonucleotide to the animal ameliorates or lessens the severity of the metabolic disorder in the animal.

2. The method of claim 1, wherein the reduction of ACC1, ACC2 or both ACC1 and ACC2 expression does not occur in the pancreas or CNS.

3. The method of claim 1, wherein the reduction of ACC1, ACC2 or both ACC1 and ACC2 expression does not cause hyperphagia or inhibition of insulin secretion.

4. The method of claim 1, wherein the antisense oligonucleotide comprises a first region comprising deoxynucleotides and a second and third region comprising 2'-O-(2-methoxyethyl)oligonucleotides.

5. The method of claim 1, wherein administering the antisense oligonucleotide lowers blood glucose, plasma triglycerides, plasma cholesterol, or liver triglycerides levels in an animal.

6. The method of claim 1, wherein administering the antisense oligonucleotide improves insulin sensitivity in an animal.

7. The method of claim 1, wherein administering the antisense oligonucleotide reduces adiposity in an animal.

8. The method of any one of claims 5, 7, wherein ACC1, ACC2, or both ACC1 and ACC2 expression is not reduced in the CNS or pancreas.

9. The method of claim 1, wherein ACC1 expression is reduced.

10. The method of claim 1, wherein ACC2 expression is reduced.

11. The method of claim 1, wherein the antisense oligonucleotide is 12 to 30 nucleobases in length and targeted to a nucleic acid molecule encoding human ACC1.

12. The method of claim 11, wherein the oligonucleotide comprises at least one chemical modification selected from a modified internucleoside linkage, a modified nucleobase, or a modified sugar.

13. The method of claim 11, wherein said oligonucleotide is a chimeric oligonucleotide having a first region comprising deoxynucleotides and a second and third region comprising 2'-O-(2-methoxyethyl)nucleotides.

14. The method of claim 11, wherein the oligonucleotide comprises at least one modified internucleoside linkage.

15. The method of claim 11, wherein the oligonucleotide comprises at least one 5-methylcytosine.

16. The method of claim 1, wherein the oligonucleotide is 12 to 30 nucleobases in length and targeted to a nucleic acid molecule encoding human ACC2.

17. The method of claim 16, wherein the oligonucleotide comprises at least one chemical modification selected from a modified internucleoside linkage, a modified nucleobase, or a modified sugar.

18. The method of claim 16, wherein said oligonucleotide is a chimeric oligonucleotide having a first region comprising deoxynucleotides and a second and third region comprising 2'-O-(2-methoxyethyl)nucleotides.

19. The method of claim 16, wherein the oligonucleotide comprises at least one modified internucleoside linkage.

20. The method of claim 16, wherein the oligonucleotide comprises at least one 5-methylcytosine.

21. The method of claim 1, wherein the antisense oligonucleotide is a chimeric oligonucleotide.

22. The method of claim 1, wherein the antisense oligonucleotide comprises at least one modified nucleobase.

23. The method of claim 1, wherein the antisense oligonucleotide comprises at least one modified internucleoside linkage.

24. The method of claim 22, wherein the modified nucleobase comprises at least one 5-methylcytosine.

25. The method of claim 23, wherein each internucleoside linkage is a phosphorothioate internucleoside linkage.

26. The method of claim 1, wherein at least one nucleoside comprises a modified sugar.

27. The method of claim 26, wherein at least one modified sugar is a bicyclic sugar.

28. The method of claim 26, wherein at least one modified sugar is a 2'-O-methoxyethyl.

29. The method of claim 1, wherein the antisense oligonucleotide is at least 90% complementary to human ACC1, human ACC2, or both human ACC1 and human ACC2.

30. The method of claim 1, wherein the antisense oligonucleotide is 100% complementary to human ACC1, human ACC2, or both human ACC1 and human ACC2.

31. The method of claim 1, wherein ACC1 and ACC2 expression is reduced.

32. The method of claim 1, wherein the disorder is obesity.

33. The method of claim 1, wherein the disorder is diabetes.

34. The method of claim 1, wherein the disorder is insulin resistance.

35. The method of claim 1, wherein the disorder is insulin deficiency.

36. The method of claim 1, wherein the disorder is hypercholesterolemia.

37. The method of claim 1, wherein the disorder is hyperglycemia.

38. The method of claim 1, wherein the disorder is hypertriglyceridemia.

39. The method of claim 1, wherein the disorder is hyperfattyacidemia.

40. The method of claim 1, wherein the disorder is liver steatosis.

41. The method of claim 1, wherein the disorder is metabolic syndrome.

* * * * *